United States Patent 9,878,004 (COMPOSITIONS AND FORMULATIONS FOR TREATMENT OF GASTROINTESTINAL TRACT MALABSORPTION DISEASES AND INFLAMMATORY CONDITIONS AND METHODS OF PRODUCTION AND USE THEREOF) - sequence listing, part 2

SEQ ID NO: 1386 - protein, 215 aa, Saccharomyces cerevisiae
  source: /note="strain ATCC 204508 / S288c"
MLGIRSSVKTCFKPMSLTSKRLISQSLLASKSTYRTPNFDDVLKENNDADKGRSYAYFMVGAMGLLSSAGAKSTVETFISSMTATADVLAMAKVEVNLAAIPLGKNVVVKWQGKPVFIRHRTPHEIQEANSVDMSALKDPQTDADRVKDPQWLIMLGICTHLGCVPIGEAGDFGGWFCPCHGSHYDISGRIRKGPAPLNLEIPAYEFDGDKVIVG

SEQ ID NO: 1387 - protein, 237 aa, Saccharomyces cerevisiae
  source: /note="strain ATCC 204508 / S288c"
MAPKKVLLALTSYNDVFYSDGAKTGVFVVEALHPFNTFRKEGFEVDFVSETGKFGWDEHSLAKDFLNGQDETDFKNKDSDFNKTLAKIKTPKEVNADDYQIFFASAGHGTLFDYPKAKDLQDIASEIYANGGVVAAVCHGPAIFDGLTDKKTGRPLIEGKSITGFTDVGETILGVDSILKAKNLATVEDVAKKYGAKYLAPVGPWDDYSITDGRLVTGVNPASAHSTAVRSIDALKN

SEQ ID NO: 1388 - protein, 273 aa, Saccharomyces cerevisiae; identical to SEQ ID NO: 609
  source: /note="strain ATCC 204508 / S288c"

SEQ ID NO: 1389 - protein, 302 aa, Saccharomyces cerevisiae
  source: /note="strain ATCC 204508 / S288c"
MFSRLSRSHSKALPIALGTVAIAAATAFYFANRNQHSFVFNESNKVFKGDDKWIDLPISKIEEESHDTRRFTFKLPTEDSEMGLVLASALFAKFVTPKGSNVVRPYTPVSDLSQKGHFQLVVKHYEGGKMTSHLFGLKPNDTVSFKGPIMKWKWQPNQFKSITLLGAGTGINPLYQLAHHIVENPNDKTKVNLLYGNKTPQDILLRKELDALKEKYPDKFNVTYFVDDKQDDQDFDGEISFISKDFIQEHVPGPKESTHLFVCGPPPFMNAYSGEKKSPKDQGELIGILNNLGYSKDQVFKF

SEQ ID NO: 1390 - protein, 333 aa, Saccharomyces cerevisiae
  source: /note="strain ATCC 204508 / S288c"
MSEPSEKKQKVATSSLEQLKKAGTHVVADSGDFEAISKYEPQDSTTNPSLILAASKLEKYARFIDAAVEYGRKHGKTDHEKIENAMDKILVEFGTQILKVVPGRVSTEVDARLSFDKKATVKKALHIIKLYKDAGVPKERVLIKIASTWEGIQAARELEVKHGIHCNMTLLFSFTQAVACAEANVTLISPFVGRIMDFYKALSGKDYTAETDPGVLSVKKIYSYYKRHGYATEVMAASFRNLDELKALAGIDNMTLPLNLLEQLYESTDPIENKLNSESAKEEGVEKVSFINDEPHFRYVLNEDQMATEKLSDGIRKFSADIEALYKLVEEKM

SEQ ID NO: 1391 - protein, 385 aa, Saccharomyces cerevisiae
  source: /note="strain ATCC 204508 / S288c"
MTKSVDTLLIPGPIILSGAVQKALDVPSLGHTSPEFVSIFQRVLKNTRAVFKSAAASKSQPFVLAGSGTLGWDIFASNFILSKAPNKNVLVVSTGTFSDRFADCLRSYGAQVDVVRPLKIGESVPLELITEKLSQNSYGAVTVTHVDTSTAVLSDLKAISQAIKQTSPETFFVVDAVCSIGCEEFEFDEWGVDFALTASQKAIGAPAGLSISLCSSRFMDYALNDSKNGHVHGYFSSLRRWTPIMENYEAGKGAYFATPPVQLINSLDVALKEILEEGLHKRWDLHREMSDWFKDSLVNGLQLTSVSRYPSNMSAHGLTAVYVADPPDVIAFLKSHGVVIAGGIHKDIGPKYIRIGHMGVTACNKNLPYMKNCFDLIKLALQRKK

SEQ ID NO: 1392 - protein, 398 aa, Saccharomyces cerevisiae
  source: /note="strain ATCC 204508 / S288c"
MSQNVYIVSTARTPIGSFQGSLSSKTAVELGAVALKGALAKVPELDASKDFDEIIFGNVLSANLGQAPARQVALAAGLSNHIVASTVNKVCASAMKAIILGAQSIKCGNADVVVAGGCESMTNAPYYMPAARAGAKFGQTVLVDGVERDGLNDAYDGLAMGVHAEKCARDWDITREQQDNFAIESYQKSQKSQKEGKFDNEIVPVTIKGFRGKPDTQVTKDEEPARLHVEKLRSARTVFQKENGTVTAANASPINDGAAAVILVSEKVLKEKNLKPLAIIKGWGEAAHQPADFTWAPSLAVPKALKHAGIEDINSVDYFEFNEAFSVVGLVNTKILKLDPSKVNVYGGAVALGHPLGCSGARVVVTLLSILQQEGGKIGVAAICNGGGGASSIVIEKI

SEQ ID NO: 1393 - protein, 491 aa, Saccharomyces cerevisiae
  source: /note="strain ATCC 204508 / S288c"
MKLSTKLCWCGIKGRLRPQKQQQLHNTNLQMTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKK

SEQ ID NO: 1394 - protein, 585 aa, Saccharomyces cerevisiae
  source: /note="strain ATCC 204508 / S288c"
MLHRHGSKQKNFENIAGKVVHDLAGLQLLSNDVQKSAVQSGHQGSNNMRDTSSQGMANKYSVPKKGLPADLSYQLIHNELTLDGNPHLNLASFVNTFTTDQARKLIDENLTKNLADNDEYPQLIELTQRCISMLAQLWHANPDEEPIGCATTGSSEAIMLGGLAMKKRWEHRMKNAGKDASKPNIIMSSACQVALEKFTRYFEVECRLVPVSHRSHHMLDPESLWDYVDENTIGCFVILGTTYTGHLENVEKVADVLSQIEAKHPDWSNTDIPIHADGASGGFIIPFGFEKEHMKAYGMERWGFNHPRVVSMNTSGHKFGLTTPGLGWVLWRDESLLADELRFKLKYLGGVEETFGLNFSRPGFQVVHQYFNFVSLGHSGYRTQFQNSLFVARAFSFELLNSSKLPGCFEIVSSIHESIENDSAPKSVKDYWEHPQAYKPGVPLVAFKLSKKFHEEYPEVPQAILSSLLRGRGWIIPNYPLPKATDGSDEKEVLRVVFRSEMKLDLAQLLIVDIESILTKLIHSYEKVCHHIELASEQTPERKSSFIYEMLLALASPQDDIPTPDEIEKKNKLKETTTRNYRGTC

SEQ ID NO: 1395 - protein, 713 aa, Saccharomyces cerevisiae
  source: /note="strain ATCC 204508 / S288c"
MSPSAVQSSKLEEQSSEIDKLKAKMSQSAATAQQKKEHEYEHLTSVKIVPQRPISDRLQPAIATHYSPHLDGLQDYQRLHKESIEDPAKFFGSKATQFLNWSKPFDKVFIPDPKTGRPSFQNNAWFLNGQLNACYNCVDRHALKTPNKKAIIFEGDEPGQGYSITYKELLEEVCQVAQVLTYSMGVRKGDTVAVYMPMVPEAIITLLAISRIGAIHSVVFAGFSSNSLRDRINDGDSKVVITTDESNRGGKVIETKRIVDDALRETPGVRHVLVYRKTNNPSVAFHAPRDLDWATEKKKYKTYYPCTPVDSEDPLFLLYTSGSTGAPKGVQHSTAGYLLGALLTMRYTFDTHQEDVFFTAGDIGWITGHTYVVYGPLLYGCATLVFEGTPAYPNYSRYWDIIDEHKVTQFYVAPTALRLLKRAGDSYIENHSLKSLRCLGSVGEPIAAEVWEWYSEKIGKNEIPIVDTYWQTESGSHLVTPLAGGVTPMKPGSASFPFFGIDAVVLDPNTGEELNTSHAEGVLAVKAAWPSFARTIWKNHDRYLDTYLNPYPGYYFTGDGAAKDKDGYIWILGRVDDVVNVSGHRLSTAEIEAAIIEDPIVAECAVVGFNDDLTGQAVAAFVVLKNKSSWSTATDDELQDIKKHLVFTVRKDIGPFAAPKLIILVDDLPKTRSGKIMRRILRKILAGESDQLGDVSTLSNPGIVRHLIDSVKL

SEQ ID NO: 1396 - protein, 835 aa, Saccharomyces cerevisiae
  source: /note="strain ATCC 204508 / S288c"
MGEEHKPLLDASGVDPREEDKTATAILRRKKKDNMLLVDDAINDDNSVIAINSNTMDKLELFRGDTVLVKGKKRKDTVLIVLIDDELEDGACRINRVVRNNLRIRLGDLVTIHPCPDIKYATRISVLPIADTIEGITGNLFDVFLKPYFVEAYRPVRKGDHFVVRGGMRQVEFKVVDVEPEEYAVVAQDTIIHWEGEPINREDEENNMNEVGYDDIGGCRKQMAQIREMVELPLRHPQLFKAIGIKPPRGVLMYGPPGTGKTLMARAVANETGAFFFLINGPEVMSKMAGESESNLRKAFEEAEKNAPAIIFIDEIDSIAPKRDKTNGEVERRVVSQLLTLMDGMKARSNVVVIAATNRPNSIDPALRRFGRFDREVDIGIPDATGRLEVLRIHTKNMKLADDVDLEALAAETHGYVGADIASLCSEAAMQQIREKMDLIDLDEDEIDAEVLDSLGVTMDNFRFALGNSNPSALRETVVESVNVTWDDVGGLDEIKEELKETVEYPVLHPDQYTKFGLSPSKGVLFYGPPGTGKTLLAKAVATEVSANFISVKGPELLSMWYGESESNIRDIFDKARAAAPTVVFLDELDSIAKARGGSLGDAGGASDRVVNQLLTEMDGMNAKKNVFVIGATNRPDQIDPAILRPGRLDQLIYVPLPDENARLSILNAQLRKTPLEPGLELTAIAKATQGFSGADLLYIVQRAAKYAIKDSIEAHRQHEAEKEVKVEGEDVEMTDEGAKAEQEPEVDPVPYITKEHFAEAMKTAKRSVSDAELRRYEAYSQQMKASRGQFSNFNFNDAPLGTTATDNANSNNSAPSGAGAAFGSNAEEDDDLYS

SEQ ID NO: 1397 - protein, 843 aa, Saccharomyces cerevisiae [sequence omitted]

SEQ ID NO: 1398 - protein, 1098 aa, Saccharomyces cerevisiae
  source: /note="strain ATCC 204508 / S288c"
MALIVASLFLPYQPQFELDTSLPENSQVDSSLVNIQAMANDQQQQRALSNNISQESLVAPAPEQGVPPAISRSATRSPSAFNRASSTTNTATLDDLVSSDIFMENLTANATTSHTPTSKTMLKPRKNGSVERFFSPSSNIPTDRIASPIQHEHDSGSRIASPIQQQQQDPTTNLLKNVNKSLLVHSLLNNTSQTSLEGPNNHIVTPKSRAGNRPTSAATSLVNRTKQGSASSGSSGSSAPPSIKRITPHLTASAAKQRPLLAKQPSNLKYSELADISSSETSSQHNESDPDDLTTAPDEEYVSDLEMDDAKQDYKVPKFGGYSNKSKLKKYALLRSSQELFSRLPWSIVPSIKGNGAMKNAINTAVLENIIPHRHVKWVGTVGIPTDEIPENILANISDSLKDKYDSYPVLTDDDTFKAAYKNYCKQILWPTLHYQIPDNPNSKAFEDHSWKFYRNLNQRFADAIVKIYKKGDTIWIHDYHLMLVPQMVRDVLPFAKIGFTLHVSFPSSEVFRCLAQREKILEGLTGADFVGFQTREYARHFLQTSNRLLMADVVHDEELKYNGRVVSVRFTPVGIDAFDLQSQLKDGSVMQWRQLIRERWQGKKLIVCRDQFDRIRGIHKKLLAYEKFLVENPEYVEKSTLIQICIGSSKDVELERQIMIVVDRINSLSTNISISQPVVFLHQDLDFSQYLALSSEADLFVVSSLREGMNLTCHEFIVCSEDKNAPLLLSEFTGSASLLNDGAIIINPWDTKNFSQAILKGLEMPFDKRRPQWKKLMKDIINNDSTNWIKTSLQDIHISWQFNQEGSKIFKLNTKTLMEDYQSSKKRMFVFNIAEPPSSRMISILNDMTSKGNIVYIMNSFPKPILENLYSRVQNIGLIAENGAYVSLNGVWYNIVDQVDWRNDVAKILEDKVERLPGSYYKINESMIKFHTENAEDQDRVASVIGDAITHINTVFDHRGIHAYVYKNVVSVQQVGLSLSAAQFLFRFYNSASDPLDTSSGQITNIQTPSQQNPSDQEQQPPASPTVSMNHIDFACVSGSSSPVLEPLFKLVNDEASEGQVKAGHAIVYGDATSTYAKEHVNGLNELFTIISRIIED

SEQ ID NO: 1399 - protein, 2214 aa, Saccharomyces cerevisiae
  source: /note="strain ATCC 204508 / S288c"
MATIAPTAPITPPMESTGDRLVTLELKDGTVLQGYSFGAEKSVAGELVFQTGMVGYPESVTDPSYEGQILVITYPLVGNYGVPDMHLRDELVEELPRYFESNRIHIAGLVISHYTDEYSHYLAKSSLGKWLQNEGIPAVYGVDTRSLTKHLRDAGSMLGRLSLEKSGSDRTISRSSSWRSAFDVPEWVDPNVQNLVSKVSINEPKLYVPPADNKHIELQTGPDGKVLRILAIDVGMKYNQIRCFIKRGVELKVVPWNYDFTKEDYDGLFISNGPGDPSVLDDLSQRLSNVLEAKKTPVFGICLGHQLIARAAGASTLKLKFGNRGHNIPCTSTISGRCYITSQNHGFAVDVDTLTSGWKPLFVNANDDSNEGIYHSELPYFSVQFHPESTPGPRDTEFLFDVFIQAVKEFKYTQVLKPIAFPGGLLEDNVKAHPRIEAKKVLVLGSGGLSIGQAGEFDYSGSQAIKALKEEGIYTILINPNIATIQTSKGLADKVYFVPVTAEFVRKVILHERPDAIYVTFGGQTALSVGIAMKDEFEALGVKVLGTPIDTIITTEDRELFSNAIDEINEKCAKSQAANSVDEALAAVKEIGFPVIVRAAYALGGLGSGFANNEKELVDLCNVAFSSSPQVLVEKSMKGWKEVEYEVVRDAFDNCITVCNMENFDPLGIHTGDSIVVAPSQTLSDEDYNMLRTTAVNVIRHLGVVGECNIQYALNPVSKDYCIIEVNARLSRSSALASKATGYPLAYTAAKLGLNIPLNEVKNSVTKSTCACFEPSLDYCVVKMPRWDLKKFTRVSTELSSSMKSVGEVMSIGRTFEEAIQKAIRSTEYANLGFNETDLDIDIDYELNNPTDMRVFAIANAFAKKGYSVDKVWEMTRIDKWFLNKLHDLVQFAEKISSFGTKEELPSLVLRQAKQLGFDDRQIARFLDSNEVAIRRLRKEYGITPFVKQIDTVAAEFPAYTNYLYMTYNADSHDLSFDDHGVMVLGSGVYRIGSSVEFDWCAVTAVRTLRANNIKTIMVNYNPETVSTDYDEADRLYFETINLERVLDIYEIENSSGVVVSMGGQTSNNIAMTLHRENVKILGTSPDMIDSAENRYKFSRMLDQIGVDQPAWKELTSMDEAESFAEKVGYPVLVRPSYVLSGAAMNTVYSKNDLESYLNQAVEVSRDYPVVITKYIENAKEIEMDAVARNGELVMHVVSEHVENAGVHSGDATLIVPPQDLAPETVDRIVVATAKIGKALKITGPYNIQFIAKDNEIKVIECNVRASRSFPFISKVVGVNLIELATKAIMGLPLTPYPVEKLPDDYVAVKVPQFSFPRLAGADPVLGVEMASTGEVATFGHSKYEAYLKSLLATGFKLPKKNILLSIGSYKEKQELLSSVQKLYNMGYKLFATSGTADFLSEHGIAVQYLEVLNKDDDDQKSEYSLTQHLANNEIDLYINLPSANRFRRPASYVSKGYKTRRLAVDYSVPLVTNVKCAKLLIEAISRNITLDVSERDAQTSHRTITLPGLINIATYVPNASHVIKGPAELKETTRLFLESGFTYCQLMPRSISGPVITDVASLKAANSVSQDSSYTDFSFTIAGTAHNAHSVTQSASKVTALFLPLRELKNKITAVAELLNQWPTEKQVIAEAKTADLASVLLLTSLQNRSIHITGVSNKEDLALIMTVKAKDPRVTCDVNIYSLFIAQDDYPEAVFLPTKEDQEFFWNNLDSIDAFSVGALPVALANVTGNKVDVGMGIKDSLPLLLAAVEEGKLTIDDIVLRLHDNPAKIFNIPTQDSVVEIDLDYSFRRNKRWSPFNKDMNGGIERVVYNGETLVLSGELVSPGAKGKCIVNPSPASITASAELQSTSAKRRFSITEEAIADNLDAAEDAIPEQPLEQKLMSSRPPRELVAPGAIQNLIRSNNPFRGRHILSIKQFKRSDFHVLFAVAQELRAAVAREGVLDLMKGHVITTIFFEPSTRTCSSFIAAMERLGGRIVNVNPLVSSVKKGETLQDTIRTLACYSDAIVMRHSEEMSVHIAAKYSPVPIINGGNGSREHPTQAFLDLFTIREEIGTVNGITVTFMGDLKHGRTVHSLCRLLMHYQVRINLVSPPELRLPEGLREELRKAGLLGVESIELTPHIISKTDVLYCTRVQEERFNSPEEYARLKDTYIVDNKILAHAKENMAIMHPLPRVNEIKEEVDYDHRAAYFRQMKYGLFVRMALLAMVMGVDM

SEQ ID NO: 1400 - protein, 85 aa, Saccharomyces cerevisiae; identical to SEQ ID NO: 641
  source: /note="strain ATCC 204508 / S288c"

SEQ ID NO: 1401 - protein, 83 aa, Saccharomyces cerevisiae; identical to SEQ ID NO: 642
  source: /note="strain ATCC 204508 / S288c"

SEQ ID NO: 1402 - protein, 111 aa, Saccharomyces cerevisiae; identical to SEQ ID NO: 632
  source: /note="strain ATCC 204508 / S288c"

SEQ ID NO: 1403 - protein, 127 aa, Saccharomyces cerevisiae
  source: /note="strain ATCC 204508 / S288c"
MAKQSLDVSSDRRKARKAYFTAPSSERRVLLSAPLSKELRAQYGIKALPIRRDDEVLVVRGSKKGQEGKISSVYRLKFAVQVDKVTKEKVNGASVPINLHPSKLVITKLHLDKDRKALIQRKGGKLE

SEQ ID NO: 1404 - protein, 136 aa, Saccharomyces cerevisiae
  source: /note="strain ATCC 204508 / S288c"
MGRVRTKTVKRASKALIERYYPKLTLDFQTNKRLCDEIATIQSKRLRNKIAGYTTHLMKRIQKGPVRGISFKLQEEERERKDQYVPEVSALDLSRSNGVLNVDNQTSDLVKSLGLKLPLSVINVSAQRDRRYRKRN

SEQ ID NO: 1405 - protein, 155 aa, Saccharomyces cerevisiae; identical to SEQ ID NO: 516
  source: /note="strain ATCC 204508 / S288c"

SEQ ID NO: 1406 - protein, 148 aa, Saccharomyces cerevisiae; identical to SEQ ID NO: 545
  source: /note="strain ATCC 204508 / S288c"

SEQ ID NO: 1407 - protein, 153 aa, Saccharomyces cerevisiae; identical to SEQ ID NO: 558
  source: /note="strain ATCC 204508 / S288c"

SEQ ID NO: 1408 - protein, 155 aa, Saccharomyces cerevisiae; identical to SEQ ID NO: 517
  source: /note="strain ATCC 204508 / S288c"

SEQ ID NO: 1409 - protein, 176 aa, Saccharomyces cerevisiae
  source: /note="strain ATCC 204508 / S288c"
MSDLVNKKFPAGDYKFQYIAISQSDADSESCKMPQTVEWSKLISENKKVIITGAPAAFSPTCTVSHIPGYINYLDELVKEKEVDQVIVVTVDNPFANQAWAKSLGVKDTTHIKFASDPGCAFTKSIGFELAVGDGVYWSGRWAMVVENGIVTYAAKETNPGTDVTVSSVESVLAHL

SEQ ID NO: 1410 - protein, 184 aa, Saccharomyces cerevisiae
  source: /note="strain ATCC 204508 / S288c"
MARYGATSTNPAKSASARGSYLRVSFKNTRETAQAINGWELTKAQKYLEQVLDHQRAIPFRRFNSSIGRTAQGKEFGVTKARWPAKSVKFVQGLLQNAAANAEAKGLDATKLYVSHIQVNQAPKQRRRTYRAHGRINKYESSPSHIELVVTEKEEAVAKAAEKKVVRLTSRQRGRIAAQKRIAA

SEQ ID NO: 1411 - protein, 186 aa, Saccharomyces cerevisiae
  source: /note="strain ATCC 204508 / S288c"
MGIDHTSKQHKRSGHRTAPKSDNVYLKLLVKLYTFLARRTDAPFNKVVLKALFLSKINRPPVSVSRIARALKQEGAANKTVVVVGTVTDDARIFEFPKTTVAALRFTAGARAKIVKAGGECITLDQLAVRAPKGQNTLILRGPRNSREAVRHFGMGPHKGKAPRILSTGRKFERARGRRRSKGFKV

SEQ ID NO: 1412 - protein, 191 aa, Saccharomyces cerevisiae
  source: /note="strain ATCC 204508 / S288c"
MKYIQTEQQIEVPEGVTVSIKSRIVKVVGPRGTLTKNLKHIDVTFTKVNNQLIKVAVHNGGRKHVAALRTVKSLVDNMITGVTKGYKYKMRYVYAHFPINVNIVEKDGAKFIEVRNFLGDKKIRNVPVRDGVTIEFSTNVKDEIVLSGNSVEDVSQNAADLQQICRVRNKDIRKFLDGIYVSHKGFITEDL

SEQ ID NO: 1413 - protein, 233 aa, Saccharomyces cerevisiae
  source: /note="strain ATCC 204508 / S288c"
MFAKTAAANLTKKGGLSLLSTTARRTKVTLPDLKWDFGALEPYISGQINELHYTKHHQTYVNGFNTAVDQFQELSDLLAKEPSPANARKMIAIQQNIKFHGGGFTNHCLFWENLAPESQGGGEPPTGALAKAIDEQFGSLDELIKLTNTKLAGVQGSGWAFIVKNLSNGGKLDVVQTYNQDTVTGPLVPLVAIDAWEHAYYLQYQNKKADYFKAIWNVVNWKEASRRFDAGKI

SEQ ID NO: 1414 - protein, 236 aa, Saccharomyces cerevisiae
  source: /note="strain ATCC 204508 / S288c"
MKLNISYPVNGSQKTFEIDDEHRIRVFFDKRIGQEVDGEAVGDEFKGYVFKISGGNDKQGFPMKQGVLLPTRIKLLLTKNVSCYRPRRDGERKRKSVRGAIVGPDLAVLALVIVKKGEQELEGLTDTTVPKRLGPKRANNIRKFFGLSKEDDVRDFVIRREVTKGEKTYTKAPKIQRLVTPQRLQRKRHQRALKVRNAQAQREAAAEYAQLLAKRLSERKAEKAEIRKRRASSLKA

SEQ ID NO: 1415 - protein, 321 aa, Saccharomyces cerevisiae
  source: /note="strain ATCC 204508 / S288c"
MVDARGSTPCLIGDSIRNVNDGNSLDFQYTNQFNEESEASRLLTPQTSSNHALSKMQKDDDIRDRSYTSVAELNREGALLTDEVDLENVDASKVRSNRDDLEAEEKRKKLLLLKKKQRNKSINSESFSSPSLRASKSNSLITSTDPVEDHISKYSSSGTPENITGEADDEDEDIIRNSYGQMIKNNSNRPHLAKGESYQSAEQEIDHTAPEKSEKRQERSGRSFDRQKSSAEFLRSLSRSISRGPTKNKTVSPSKGEDSRMYSTSNYSISLVDLENGPKIIPETLEEEQEDAEKEGVLMEDEGNEEYTKDLEEAANKAQPQ

SEQ ID NO: 1416 - protein, 327 aa, Saccharomyces cerevisiae
  source: /note="strain ATCC 204508 / S288c"
MSSLVTLNNGLKMPLVGLGCWKIDKKVCANQIYEAIKLGYRLFDGACDYGNEKEVGEGIRKAISEGLVSRKDIFVVSKLWNNFHHPDHVKLALKKTLSDMGLDYLDLYYIHFPIAFKYVPFEEKYPPGFYTGADDEKKGHITEAHVPIIDTYRALEECVDEGLIKSIGVSNFQGSLIQDLLRGCRIKPVALQIEHHPYLTQEHLVEFCKLHDIQVVAYSSFGPQSFIEMDLQLAKTTPTLFENDVIKKVSQNHPGSTTSQVLLRWATQRGIAVIPKSSKKERLLGNLEIEKKFTLTEQELKDISALNANIRFNDPWTWLDGKFPTFA

SEQ ID NO: 1417 - protein, 326 aa, Saccharomyces cerevisiae
  source: /note="strain ATCC 204508 / S288c"
MSFNAFASSLSKKLQEISTSVSEKTQELPSLAQSTQRMVQERLGQVTDISQLPREYTELEDKVDTIKLIYNHFLGVTAIYENGSYDYPKYINESVNEFSRSVASKLTELTHATSASEAQNILVAPGPIKEPKTLNYALSKVALNSSECLNKMFPTEEQPLASALLQFSDVQAKIAQARIQQDTLIQTKFNKNLRERLSFEIGKADKCRKDVHSMRLRYDVARTNLANNKKPEKEASLRVQMETLEDQFAQVTEDATVCLQEVISHANFSEDLKELAKAQAEYFETSAGLMKEFLSNSFAEEPEAKPEVAEEEKPQTAISMNDEDDA

SEQ ID NO: 1418 - protein, 360 aa, Saccharomyces cerevisiae
  source: /note="strain ATCC 204508 / S288c"
MLNRTIAKRTLATAAQAERTLPKKYGGRFTVTLIPGDGVGKEITDSVRTIFEAENIPIDWETINIKQTDHKEGVYEAVESLKRNKIGLKGLWHTPADQTGHGSLNVALRKQLDIYANVALFKSLKGVKTRIPDIDLIVIRENTEGEFSGLEHESVPGVVESLKVMTRPKTERIARFAFDFAKKYNRKSVTAVHKANIMKLGDGLFRNIITEIGQKEYPDIDVSSIIVDNASMQAVAKPHQFDVLVTPSMYGTILGNIGAALIGGPGLVAGANFGRDYAVFEPGSRHVGLDIKGQNVANPTAMILSSTLMLNHLGLNEYATRISKAVHETIAEGKHTTRDIGGSSSTTDFTNEIINKLSTM

SEQ ID NO: 1419 - protein, 361 aa, Saccharomyces cerevisiae
  source: /note="strain ATCC 204508 / S288c"
MKGLILVGGYGTRLRPLTLTVPKPLVEFGNRPMILHQIEALANAGVTDIVLAVNYRPEVMVETLKKYEKEYGVNITFSVETEPLGTAGPLKLAEDVLKKDNSPFFVLNSDVICEYPFKELADFHKAHGGKGTIVATKVDEPSKYGVIVHDIATPNLIDRFVEKPKEFVGNRINAGLYILNPEVIDLIEMKPTSIEKETFPILVEEKQLYSFDLEGFWMDVGQPKDFLSGTVLYLNSLAKRQPKKLATGANIVGNALIDPTAKISSTAKIGPDVVIGPNVTIGDGVRITRSVVLCNSTIKNHSLVKSTIVGWNSTVGQWCRLEGVTVLGDDVEVKDEIYINGGKVLPHKSISDNVPKEAIIM

SEQ ID NO: 1420 - protein, 369 aa, Saccharomyces cerevisiae
  source: /note="strain ATCC 204508 / S288c"
MLRNTFFRNTSRRFLATVKQPSIGRYTGKPNPSTGKYTVSFIEGDGIGPEISKSVKKIFSAANVPIEWESCDVSPIFVNGLTTIPDPAVQSITKNLVALKGPLATPIGKGHRSLNLTLRKTFGLFANVRPAKSIEGFKTTYENVDLVLIRENTEGEYSGIEHIVCPGVVQSIKLITRDASERVIRYAFEYARAIGRPRVIVVHKSTIQRLADGLFVNVAKELSKEYPDLTLETELIDNSVLKVVTNPSAYTDAVSVCPNLYGDILSDLNSGLSAGSLGLTPSANIGHKISIFEAVHGSAPDIAGQDKANPTALLLSSVMMLNHMGLTNHADQIQNAVLSTIASGPENRTGDLAGTATTSSFTEAVIKRL

SEQ ID NO: 1421 - protein, 382 aa, Saccharomyces cerevisiae
  source: /note="strain ATCC 204508 / S288c"
MRALAYFKKGDIHFTNDIPRPEIQTDDEVIIDVSWCGICGSDLHEYLDGPIFMPKDGECHKLSNAALPLAMGHEMSGIVSKVGPKVTKVKVGDHVVVDAASSCADLHCWPHSKFYNSKPCDACQRGSENLCTHAGFVGLGVISGGFAEQVVVSQHHIIPVPKEIPLDVAALVEPLSVTWHAVKISGFKKGSSALVLGAGPIGLCTILVLKGMGASKIVVSEIAERRIEMAKKLGVEVFNPSKHGHKSIEILRGLTKSHDGFDYSYDCSGIQVTFETSLKALTFKGTATNIAVWGPKPVPFQPMDVTLQEKVMTGSIGYVVEDFEEVVRAIHNGDIAMEDCKQLITGKQRIEDGWEKGFQELMDHKESNVKILLTPNNHGEMK

SEQ ID NO: 1422 - protein, 393 aa, Saccharomyces cerevisiae
  source: /note="strain ATCC 204508 / S288c"
MNRNTTTNKNANLNNSRNANAPGEAGHQNKTGLIYWTNPSKSGASFAATLVSLLILRNVNVISVLLKIGYMVLFTSFAVELSTKVLFDKGVVSRFGMQESPDLVGVLKPHIDRELDRLPALEDRIRKLVFAHRTRNNFTIGVSLYFLHGLFAIFSMNTVLIMTTIFLYTVPLIYDRKQARIDRAIDRMKDLVIHRFHKNYNKVVEKTEPYIDKIIPPQTDEGSYSTSISNENKSSTSQRNKSGLSSSEFDNMNDTSASKSGKDSYSTSQYNRAEYPVSQNENIGTLKSGKQEIPTEKDFNNRHENFSKPDVKTYDPRTVDIEEELAAHQRELEQNLKDGDYNLVGSKEIPDPITVPAPTRHTTKPAESQSIPIKNNETLHKTTHGLKQKLQHA

SEQ ID NO: 1423 - protein, 405 aa, Saccharomyces cerevisiae
  source: /note="strain ATCC 204508 / S288c"
MFSLKALLPLALLLVSANQVAAKVHKAKIYKHELSDEMKEVTFEQHLAHLGQKYLTQFEKANPEVVFSREHPFFTEGGHDVPLTNYLNAQYYTDITLGTPPQNFKVILDTGSSNLWVPSNECGSLACFLHSKYDHEASSSYKANGTEFAIQYGTGSLEGYISQDTLSIGDLTIPKQDFAEATSEPGLTFAFGKFDGILGLGYDTISVDKVVPPFYNAIQQDLLDEKRFAFYLGDTSKDTENGGEATFGGIDESKFKGDITWLPVRRKAYWEVKFEGIGLGDEYAELESHGAAIDTGTSLITLPSGLAEMINAEIGAKKGWTGQYTLDCNTRDNLPDLIFNFNGYNFTIGPYDYTLEVSGSCISAITPMDFPEPVGPLAIVGDAFLRKYYSIYDLGNNAVGLAKAI

SEQ ID NO: 1424 - protein, 412 aa, Saccharomyces cerevisiae
  source: /note="strain ATCC 204508 / S288c"
MSQGTLYINRSPRNYASEALISYFKLDVKIVDLEQSSEFASLFPLKQAPAFLGPKGLKLTEALAIQFYLANQVADEKERARLLGSDVIEKSQILRWASLANSDVMSNIARPFLSFKGLIPYNKKDVDACFVKIDNLAAVFDARLRDYTFVATENISLGDLHAAGSWAFGLATILGPEWRAKHPHLMRWFNTVAASPIVKTPFAEVKLAEKALTYTPPKKQKAEKPKAEKSKAEKKKDEAKPADDAAPAKKPKHPLEALGKSTFVLDDWKRKYSNDDTRPVALPWFWEHYNPEEYSIWKVGYKYNDELTLTFMSNNLVGGFFNRLSASTKYMFGCLVVYGENNNNGIVGAVMVRGQDFAPAFDVAPDWESYEYTKLDPTKEEDKEFVNNMWAWDKPVVVNGEDKEIVDGKVLK

SEQ ID NO: 1425 - protein, 500 aa, Saccharomyces cerevisiae
  source: /note="strain ATCC 204508 / S288c"
MSFENLHKVNAEALEDAVVEICSSLQVDAAKLDELTAYFIECMEKGLNNTSVGEEKTVDKGLPMIPTYVTSLPNGTERGVLLAADLGGTHFRVCSVTLNGDGTFDMQQLKSKIPEEYLNDKDVTSEELFSYLGRRTRAFVRKHHPELLKSTGENIKPLKMGFTFSYPVDQTSLSSGTLIRWTKSFKIEDTVGKDVVRLYQEQLDIQGLSMINVVALTNDTVGTFLSHCYTSGSRPSSAGEISEPVIGCIFGTGTNGCYMEDIENIKKLPDELRTRLLHEGKTQMCINIEWGSFDNELKHLSATKYDIDIDQKFSPNPGYHLFEKRISGMYLGELLRNILVDLHARGLILGQYRNYDQLPHRLKTPFQLCSEVLSRIEIDDSTNLRETELSFLQSLRLPTTFEERKAIQNLVRSITRRSAYLAAVPIAAILIKTNALNKRYHGEVEIGFDGYVIEYYPGFRSMLRHALALSPIGTEGERKIHLRLAKDGSGVGAALCALVA

SEQ ID NO: 1426 - protein, 523 aa, Saccharomyces cerevisiae
  source: /note="strain ATCC 204508 / S288c"
MAAVRDYKTALEFAKSLPRLDGLSVQELMDSKTRGGLTYNDFLVLPGLVDFPSSEVSLQTKLTRNITLNTPFVSSPMDTVTESEMAIFMALLGGIGFIHHNCTPEDQADMVRRVKNYENGFINNPIVISPTTTVGEAKSMKERFGFSGFPVTEDGKRNGKLMGIVTSRDIQFVEDNSLLVQDVMTKNPVTGAQGITLSEGNEILKKIKKGKLLIVDDNGNLVSMLSRTDLMKNQNYPLASKSATTKQLLCGAAIGTIDADKERLRLLVEAGLDVVILDSSQGNSIFQLNMIKWIKETFPDLEIIAGNVATREQAANLIAAGADGLRIGMGSGSICITQEVMACGRPQGTAVYNVCEFANQFGIPCMADGGVQNIGHITKALALGSSTVMMGGMLAGTTESPGEYFYQDGKRLKAYRGMGSIDAMQKTGTKGNASTSRYFSESDSVLVAQGVSGAVVDKGSIKKFIPYLYNGLQHSCQDIGYKSLTLLKENVQSGKVRFEFRTASAQLEGGVHNLHSYEKRLHN

SEQ ID NO: 1427 - protein, 526 aa, Saccharomyces cerevisiae
  source: /note="strain ATCC 204508 / S288c"
MTISNLLKQRVRYAPYLKKVKEAHELIPLFKNGQYLGWSGFTGVGTPKAVPEALIDHVEKNNLQGKLRFNLFVGASAGPEENRWAEHDMIIKRAPHQVGKPIAKAINQGRIEFFDKHLSMFPQDLTYGFYTRERKDNKILDYTIIEATAIKEDGSIVPGPSVGGSPEFITVSDKVIIEVNTATPSFEGIHDIDMPVNPPFRKPYPYLKVDDKCGVDSIPVDPEKVVAIVESTMRDQVPPNTPSDDMSRAIAGHLVEFFRNEVKHGRLPENLLPLQSGIGNIANAVIEGLAGAQFKHLTVWTEVLQDSFLDLFENGSLDYATATSVRLTEKGFDRAFANWENFKHRLCLRSQVVSNNPEMIRRLGVIAMNTPVEVDIYAHANSTNVNGSRMLNGLGGSADFLRNAKLSIMHAPSARPTKVDPTGISTIVPMASHVDQTEHDLDILVTDQGLADLRGLSPKERAREIINKCAHPDYQALLTDYLDRAEHYAKKHNCLHEPHMLKNAFKFHTNLAEKGTMKVDSWEPVD

SEQ ID NO: 1428 - protein, 537 aa, Saccharomyces cerevisiae
  source: /note="strain ATCC 204508 / S288c"
MHFSLKQLAVAAFYATNLGSAYVIPQFFQEAFQQEEPIENYLPQLNDDDSSAVAANIPKPHIPYFMKPHVESEKLQDKIKVDDLNATAWDLYRLANYSTPDYGHPTRVIGSKGHNKTMEYILNVFDDMQDYYDVSLQEFEALSGKIISFNLSDAETGKSFANTTAFALSPPVDGFVGKLVEIPNLGCEEKDYASVVPPRHNEKQIALIERGKCPFGDKSNLAGKFGFTAVVIYDNEPKSKEGLHGTLGEPTKHTVATVGVPYKVGKKLIANIALNIDYSLYFAMDSYVEFIKTQNIIADTKHGDPDNIVALGAHSDSVEEGPGINDDGSGTISLLNVAKQLTHFKINNKVRFAWWAAEEEGLLGSNFYAYNLTKEENSKIRVFMDYDMMASPNYEYEIYDANNKENPKGSEELKNLYVDYYKAHHLNYTLVPFDGRSDYVGFINNGIPAGGIATGAEKNNVNNGKVLDRCYHQLCDDVSNLSWDAFITNTKLIAHSVATYADSFEGFPKRETQKHKEVDILNAQQPQFKYRADFLII

SEQ ID NO: 1429 - protein, 513 aa, Saccharomyces cerevisiae
  source: /note="strain ATCC 204508 / S288c"
MKQFKLVNAVSASFVLIGLVLANSDSVFDKWTQEDLADYLRDNKKSLEKYATDSIEDLKTEASQVWDKHAQPKPWWQVWSSDSSSVSNSNPGWFGYTGSSDHPVSDWLFDTWSTDSLRNFLKKNGVDVDDAKASKDSLVKTAKENFNKISKSLKSSGYYPSSSYFDSWSTKDLQNWLNDNGIDYDKAVQSKDELVQKVKENIYRTSEKAEQQRLGLLESLDLAHQQILDTSGQIKDTVFDKWSSDQLTNWLESHKVNIDKNMAKKHDYLVRMAKENSANLKDDIYWYLDYMKRESSPFLTKTPEYVGSVWDSSKNFLTNLYSKFRGKTDNVINDTFLVGLDSWPKDKLKMFLDARGIKYSMLSTEHQLRELVKKSRNEKLKILPKDYQKYFDNSNWSLDDIKGWFADKKDDFQDSQTYSTIMQDFDKVSKNTNDAKDQIAKTWSNTFQSWSQEDLLQYLKSFGVPVKQTSTKDDLINLAKQNTQWLFGTVKEPAYKRYLHNVKNWSKSILGFN

SEQ ID NO: 1430 - protein, 589 aa, Saccharomyces cerevisiae
  source: /note="strain ATCC 204508 / S288c"
MSLTADEYKQQGNAAFTAKDYDKAIELFTKAIEVSETPNHVLYSNRSACYTSLKKFSDALNDANECVKINPSWSKGYNRLGAAHLGLGDLDEAESNYKKALELDASNKAAKEGLDQVHRTQQARQAQPDLGLTQLFADPNLIENLKKNPKTSEMMKDPQLVAKLIGYKQNPQAIGQDLFTDPRLMTIMATLMGVDLNMDDINQSNSMPKEPETSKSTEQKKDAEPQSDSTTSKENSSKAPQKEESKESEPMEVDEDDSKIEADKEKAEGNKFYKARQFDEAIEHYNKAWELHKDITYLNNRAAAEYEKGEYETAISTLNDAVEQGREMRADYKVISKSFARIGNAYHKLGDLKKTIEYYQKSLTEHRTADILTKLRNAEKELKKAEAEAYVNPEKAEEARLEGKEYFTKSDWPNAVKAYTEMIKRAPEDARGYSNRAAALAKLMSFPEAIADCNKAIEKDPNFVRAYIRKATAQIAVKEYASALETLDAARTKDAEVNNGSSAREIDQLYYKASQQRFQPGTSNETPEETYQRAMKDPEVAAIMQDPVMQSILQQAQQNPAALQEHMKNPEVFKKIQTLIAAGIIRTGR

SEQ ID NO: 1431 - protein, 640 aa, Saccharomyces cerevisiae
  source: /note="strain ATCC 204508 / S288c"
MLSLKKSALSKLTLLRNTRTFTSSALVRQTQGSVNGSASRSADGKYHIIDHEYDCVVIGAGGAGLRAAFGLAEAGYKTACISKLFPTRSHTVAAQGGINAALGNMHKDNWKWHMYDTVKGSDWLGDQDSIHYMTREAPKSIIELEHYGVPFSRTENGKIYQRAFGGQTKEYGKGAQAYRTCAVADRTGHALLHTLYGQALRHDTHFFIEYFALDLLTHNGEVVGVIAYNQEDGTIHRFRAHKTIIATGGYGRAYFSCTSAHTCTGDGNAMVSRAGFPLQDLEFVQFHPSGIYGSGCLITEGARGEGGFLVNSEGERFMERYAPTAKDLACRDVVSRAITMEIREGRGVGKKKDHMYLQLSHLPPEVLKERLPGISETAAIFAGVDVTKEPIPIIPTVHYNMGGIPTKWNGEALTIDEETGEDKVIPGLMACGEAACVSVHGANRLGANSLLDLVVFGRAVAHTVADTLQPGLPHKPLPSDLGKESIANLDKLRNANGSRSTAEIRMNMKQTMQKDVSVFRTQSSLDEGVRNITAVEKTFDDVKTTDRSMIWNSDLVETLELQNLLTCASQTAVSAANRKESRGAHAREDYPNRDDEHWMKHTLSWQKDVAAPVTLKYRRVIDHTLDEKECPSVPPTVRAY

SEQ ID NO: 1432 - protein, 802 aa, Saccharomyces cerevisiae
  source: /note="strain ATCC 204508 / S288c"
MLNILVLGNGAREHVLVTKLAQSPTVGKIYVAPGNGGTATMDPSRVINWDITPDVANFARLQSMAVEHKINLVVPGPELPLVNGITSVFHSVGIPVFGPSVKAAQLEASKAFSKRFMSKHNIPTASYDVFTNPEEAISFLQAHTDKAFVIKADGIAAGKGVIIPSSIDESVQAIKDIMVTKQFGEEAGKQVVIEQFLEGDEISLLTIVDGYSHFNLPVAQDHKRIFDGDKGLNTGGMGAYAPAPVATPSLLKTIDSQIVKPTIDGMRRDGMPFVGVLFTGMILVKDSKTNQLVPEVLEYNVRFGDPETQAVLSLLDDQTDLAQVFLAAAEHRLDSVNIGIDDTRSAVTVVVAAGGYPESYAKGDKITLDTDKLPPHTQIFQAGTKYDSATDSLLTNGGRVLSVTSTAQDLRTAVDTVYEAVKCVHFQNSYYRKDIAYRAFQNSESSKVAITYADSGVSVDNGNNLVQTIKEMVRSTRRPGADSDIGGFGGLFDLAQAGFRQNEDTLLVGATDGVGTKLIIAQETGIHNTVGIDLVAMNVNDLVVQGAEPLFFLDYFATGALDIQVASDFVSGVANGCIQSGCALVGGETSEMPGMYPPGHYDTNGTAVGAVLRQDILPKINEMAAGDVLLGLASSGVHSNGFSLVRKIIQHVALPWDAPCPWDESKTLGEGILEPTKIYVKQLLPSIRQRLLLGLAHITGGGLVENIPRAIPDHLQARVDMSTWEVPRVFKWFGQAGNVPHDDILRTFNMGVGMVLIVKRENVKAVCDSLTEEGEIIWELGSLQERPKDAPGCVIENGTKLY

SEQ ID NO: 1433 - protein, 56 aa, Saccharomyces cerevisiae
  source: /note="strain ATCC 204508 / S288c"
MAHENVWFSHPRRFGKGSRQCRVCSSHTGLVRKYDLNICRQCFREKANDIGFHKYR

SEQ ID NO: 1434 - protein, 103 aa, Saccharomyces cerevisiae
  source: /note="strain ATCC 204508 / S288c"
MSGRGKGGKGLGKGGAKRHRKILRDNIQGITKPAIRRLARRGGVKRISGLIYEEVRAVLKSFLESVIRDSVTYTEHAKRKTVTSLDVVYALKRQGRTLYGFGG

SEQ ID NO: 1435 - protein, 104 aa, Saccharomyces cerevisiae
  source: /note="strain ATCC 204508 / S288c"
MVTQLKSASEYDSALASGDKLVVVDFFATWCGPCKMIAPMIEKFAEQYSDAAFYKLDVDEVSDVAQKAEVSSMPTLIFYKGGKEVTRVVGANPAAIKQAIASNV

SEQ ID NO: 1436 - protein, 114 aa, Saccharomyces cerevisiae
  source: /note="strain ATCC 204508 / S288c"
MSEVIEGNVKIDRISPGDGATFPKTGDLVTIHYTGTLENGQKFDSSVDRGSPFQCNIGVGQVIKGWDVGIPKLSVGEKARLTIPGPYAYGPRGFPGLIPPNSTLVFDVELLKVN

SEQ ID NO: 1437 - protein, 115 aa, Saccharomyces cerevisiae
  source: /note="strain ATCC 204508 / S288c"
MGSFWDAFAVYDKKKHADPSVYGGNHNNTGDSKTQVMFSKEYRQPRTHQQENLQSMRRSSIGSQDSSDVEDVKEGRLPAEVEIPKNVDISNMSQGEFLRLYESLRRGEPDNKVNR

SEQ ID NO: 1438 - protein, 131 aa, Saccharomyces cerevisiae; identical to SEQ ID NO: 577
  source: /note="strain ATCC 204508 / S288c"

SEQ ID NO: 1439 - protein, 121 aa, Saccharomyces cerevisiae; identical to SEQ ID NO: 628
  source: /note="strain ATCC 204508 / S288c"

SEQ ID NO: 1440 - protein, 130 aa, Saccharomyces cerevisiae
  source: /note="strain ATCC 204508 / S288c"
MASLPHPKIVKKHTKKFKRHHSDRYHRVAENWRKQKGIDSVVRRRFRGNISQPKIGYGSNKKTKFLSPSGHKTFLVANVKDLETLTMHTKTYAAEIAHNISAKNRVVILARAKALGIKVTNPKGRLALEA

SEQ ID NO: 1441 - protein, 135 aa, Saccharomyces cerevisiae
  source: /note="strain ATCC 204508 / S288c"
MFLRTQARFFHATTKKMDFSKMSIVGRIGSEFTEHTSANNNRYLKYSIASQPRRDGQTNWYNITVFNEPQINFLTEYVRKGALVYVEADAANYVFERDDGSKGTTLSLVQKDINLLKNGKKLEDAEGQENAASSE

SEQ ID NO: 1442 - protein, 138 aa, Saccharomyces cerevisiae
  source: /note="strain ATCC 204508 / S288c"
MSTDSIVKASNWRLVEVGRVVLIKKGQSAGKLAAIVEIIDQKKVLIDGPKAGVPRQAINLGQVVLTPLTFALPRGARTATVSKKWAAAGVCEKWAASSWAKKIAQRERRAALTDFERFQVMVLRKQKRYTVKKALAKA

SEQ ID NO: 1443 - protein, 143 aa, Saccharomyces cerevisiae
  source: /note="strain ATCC 204508 / S288c"
MSRSGVAVADESLTAFNDLKLGKKYKFILFGLNDAKTEIVVKETSTDPSYDAFLEKLPENDCLYAIYDFEYEINGNEGKRSKIVFFTWSPDTAPVRSKMVYASSKDALRRALNGVSTDVQGTDFSEVSYDSVLERVSRGAGSH

SEQ ID NO: 1444 - protein, 142 aa, Saccharomyces cerevisiae
  source: /note="strain ATCC 204508 / S288c"
MSQAVNAKKRVFKTHSYRGVDLEKLLEMSTEDFVKLAPARVRRRFARGMTSKPAGFMKKLRAAKLAAPENEKPAPVRTHMRNMIIVPEMIGSVVGIYNGKAFNQVEIRPEMLGHYLGEFSITYTPVRHGRAGATTSRFIPLK

SEQ ID NO: 1445 - protein, 165 aa, Saccharomyces cerevisiae
  source: /note="strain ATCC 204508 / S288c"
MPPKFDPNEVKYLYLRAVGGEVGASAALAPKIGPLGLSPKKVGEDIAKATKEFKGIKVTVQLKIQNRQAAASVVPSASSLVITALKEPPRDRKKDKNVKHSGNIQLDEIIEIARQMRDKSFGRTLASVTKEILGTAQSVGCRVDFKNPHDIIEGINAGEIEIPEN

SEQ ID NO: 1446 - protein, 161 aa, Saccharomyces cerevisiae
  source: /note="strain ATCC 204508 / S288c"
MEKIKEKLNSLKLESESWQEKYEELREQLKELEQSNTEKENEIKSLSAKNEQLDSEVEKLESQLSDTKQLAEDSNNLRSNNENYTKKNQDLEQQLEDSEAKLKEAMDKLKEADLNSEQMGRRIVALEEERDEWEKKCEEFQSKYEEAQKELDEIANSLENL

SEQ ID NO: 1447 - protein, 174 aa, Saccharomyces cerevisiae
  source: /note="strain ATCC 204508 / S288c"
MSTKAQNPMRDLKIEKLVLNISVGESGDRLTRASKVLEQLSGQTPVQSKARYTVRTFGIRRNEKIAVHVTVRGPKAEEILERGLKVKEYQLRDRNFSATGNFGFGIDEHIDLGIKYDPSIGIFGMDFYVVMNRPGARVTRRKRCKGTVGNSHKTTKEDTVSWFKQKYDADVLDK

SEQ ID NO: 1448 - protein, 180 aa, Saccharomyces cerevisiae
  source: /note="strain ATCC 204508 / S288c"
MSEYASSIHSQMKQFDTKYSGNRILQQLENKTNLPKSYLVAGLGFAYLLLIFINVGGVGEILSNFAGFVLPAYLSLVALKTPTSTDDTQLLTYWIVFSFLSVIEFWSKAILYLIPFYWFLKTVFLIYIALPQTGGARMIYQKIVAPLTDRYILRDVSKTEKDEIRASVNEASKATGASVH

SEQ ID NO: 1449 - protein, 193 aa, Saccharomyces cerevisiae
  source: /note="strain ATCC 204508 / S288c"
MSAVATYLKTLTARRTIYALKPELPGEITINDIQSVVQTIIKETPTAFNSQPNRAVILTGETHKKVWDEVTKAIESPAGQKRPASARDEAFGSVIFFTDDKVTEKLKADFPAYAAAFPSFADHTSGAAQINSWVALEAMGLGGHLQHYNGYIKAALPSKIPESWTVQAQLVFGTPAAPPGEKTYIKNDVEIFN

SEQ ID NO: 1450 - protein, 194 aa, Saccharomyces cerevisiae; identical to SEQ ID NO: 496
  source: /note="strain ATCC 204508 / S288c"

SEQ ID NO: 1451 - protein, 198 aa, Saccharomyces cerevisiae
  source: /note="strain ATCC 204508 / S288c"
MSQPVVVIDAKDHLLGRLASTIAKQVLNGQKIVVVRAEALNISGEFFRNKLKYHDFLRKATAFNKTRGPFHFRAPSRILYKAIRGMVSHKTARGKAALERLKIFEGIPPPYDKKKRVVVPQALRVLRLKPGRKYTTLGKLSTSVGWKYEDVVAKLEDKRKVRSAEYYAKKRAFTKKVSSASAAASESDVAKQLASFGY

SEQ ID NO: 1452 - protein, 206 aa, Saccharomyces cerevisiae
  source: /note="strain ATCC 204508 / S288c"
MASTDFSKIETLKQLNASLADKSYIEGTAVSQADVTVFKAFQSAYPEFSRWFNHIASKADEFDSFPAASAAAAEEEEDDDVDLFGSDDEEADAEAEKLKAERIAAYNAKKAAKPAKPAAKSIVTLDVKPWDDETNLEEMVANVKAIEMEGLTWGAHQFIPIGFGIKKLQINCVVEDDKVSLDDLQQSIEEDEDHVQSTDIAAMQKL

SEQ ID NO: 1453 - protein, 216 aa, Saccharomyces cerevisiae
  source: /note="strain ATCC 204508 / S288c"
MKTLIVVDMQNDFISPLGSLTVPKGEELINPISDLMQDADRDWHRIVVTRDWHPSRHISFAKNHKDKEPYSTYTYHSPRPGDDSTQEGILWPVHCVKNTWGSQLVDQIMDQVVTKHIKIVDKGFLTDREYYSAFHDIWNFHKTDMNKYLEKHHTDEVYIVGVALEYCVKATAISAAELGYKTTVLLDYTRPISDDPEVINKVKEELKAHNINVVDK

SEQ ID NO: 1454 - protein, 219 aa, Saccharomyces cerevisiae
  source: /note="strain ATCC 204508 / S288c"
MSAPAANGEVPTFKLVLVGDGGTGKTTFVKRHLTGEFEKKYIATIGVEVHPLSFYTNFGEIKFDVWDTAGQEKFGGLRDGYYINAQCAIIMFDVTSRITYKNVPNWHRDLVRVCENIPIVLCGNKVDVKERKVKAKTITFHRKKNLQYYDISAKSNYNFEKPFLWLARKLAGNPQLEFVASPALAPPEVQVDEQLMQQYQQEMEQATALPLPDEDDADL

SEQ ID NO: 1455 - protein, 233 aa, Saccharomyces cerevisiae; identical to SEQ ID NO: 484
  source: /note="strain ATCC 204508 / S288c"

SEQ ID NO: 1456 - protein, 244 aa, Saccharomyces cerevisiae
  source: /note="strain ATCC 204508 / S288c"
MSMSMGVRGLALRSVSKTLFSQGVRCPSMVIGARYMSSTPEKQTDPKAKANSIINAIPGNNILTKTGVLGTSAAAVIYAISNELYVINDESILLLTFLGFTGLVAKYLAPAYKDFADARMKKVSDVLNASRNKHVEAVKDRIDSVSQLQNVAETTKVLFDVSKETVELESEAFELKQKVELAHEAKAVLDSWVRYEASLRQLEQRQLAKSVISRVQSELGNPKFQEKVLQQSISEIEQLLSKLK

SEQ ID NO: 1457 - protein, 250 aa, Saccharomyces cerevisiae
  source: /note="strain ATCC 204508 / S288c"
MGLTTKPLSLKVNAALFDVDGTIIISQPAIAAFWRDFGKDKPYFDAEHVIQVSHGWRTFDAIAKFAPDFANEEYVNKLEAEIPVKYGEKSIEVPGAVKLCNALNALPKEKWAVATSGTRDMAQKWFEHLGIRRPKYFITANDVKQGKPHPEPYLKGRNGLGYPINEQDPSKSKVVVFEDAPAGIAAGKAAGCKIIGIATTFDLDFLKEKGCDIIVKNHESIRVGGYNAETDEVEFIFDDYLYAKDDLLKW

SEQ ID NO: 1458 - protein, 306 aa, Saccharomyces cerevisiae
  source: /note="strain ATCC 204508 / S288c"
MSITKTELDGILPLVARGKVRDIYEVDAGTLLFVATDRISAYDVIMENSIPEKGILLTKLSEFWFKFLSNDVRNHLVDIAPGKTIFDYLPAKLSEPKYKTQLEDRSLLVHKHKLIPLEVIVRGYITGSAWKEYVKTGTVHGLKQPQGLKESQEFPEPIFTPSTKAEQGEHDENISPAQAAELVGEDLSRRVAELAVKLYSKCKDYAKEKGIIIADTKFEFGIDEKTNEIILVDEVLTPDSSRFWNGASYKVGESQDSYDKQFLRDWLTANKLNGVNGVKMPQDIVDRTRAKYIEAYETLTGSKWSH

SEQ ID NO: 1459 - protein, 340 aa, Saccharomyces cerevisiae
  source: /note="strain ATCC 204508 / S288c"
MTAPLVVLGNPLLDFQADVTAEYLAKYSLKENDAILVDAKSGDAKMAIFDELLQMPETKLVAGGAAQNTARGAAYVLGAGQVVYFGSVGKDKFSERLLNENEKAGVKSMYQVQNDIGTGKCAALITGHNRSLVTDLGAANFFTPDHLDKHWDLVEAAKLFYIGGFHLTVSPDAIVKLGQHAKENSKPFVLNFSAPFIPHVFKDALARVLPYATVIIANESEAEAFCDAFQLDCANTDLEAIAQRIVKDSPVEKTVIFTHGVEPTVVVSSKGTSTYPVKPLDSSKIVDTNGAGDAFAGGFMAGLTKGEDLETSIDMGQWLAALSIQEVGPSYPSEKISYSK

SEQ ID NO: 1460 - protein, 370 aa, Saccharomyces cerevisiae
  source: /note="strain ATCC 204508 / S288c"
MSESPMFAANGMPKVNQGAEEDVRILGYDPLASPALLQVQIPATPTSLETAKRGRREAIDIITGKDDRVLVIVGPCSIHDLEAAQEYALRLKKLSDELKGDLSIIMRAYLEKPRTTVGWKGLINDPDVNNTFNINKGLQSARQLFVNLTNIGLPIGSEMLDTISPQYLADLVSFGAIGARTTESQLHRELASGLSFPVGFKNGTDGTLNVAVDACQAAAHSHHFMGVTKHGVAAITTTKGNEHCFVILRGGKKGTNYDAKSVAEAKAQLPAGSNGLMIDYSHGNSNKDFRNQPKVNDVVCEQIANGENAITGVMIESNINEGNQGIPAEGKAGLKYGVSITDACIGWETTEDVLRKLAAAVRQRREVNKK

SEQ ID NO: 1461 - protein, 365 aa, Saccharomyces cerevisiae
  source: /note="strain ATCC 204508 / S288c"
MAGKKIAGVLGATGSVGQRFILLLANHPHFELKVLGASSRSAGKKYVDAVNWKQTDLLPESATDIIVSECKSEFFKECDIVFSGLDADYAGAIEKEFMEAGIAIVSNAKNYRREQDVPLIVPVVNPEHLDIVAQKLDTAKAQGKPRPGFIICISNCSTAGLVAPLKPLIEKFGPIDALTTTTLQAISGAGFSPGVPGIDILDNIIPYIGGEEDKMEWETKKILAPLAEDKTHVKLLTPEEIKVSAQCNRVAVSDGHTECISLRFKNRPAPSVEQVKTCLKEYVCDAYKLGCHSAPKQTIHVLEQPDRPQPRLDRNRDSGYGVSVGRIREDPLLDFKMVVLSHNTIIGAAGSGVLIAEILLARNLI

SEQ ID NO: 1462 - protein, 386 aa, Saccharomyces cerevisiae
  source: /note="strain ATCC 204508 / S288c"
MSAATVGKPIKCIAAVAYDAKKPLSVEEITVDAPKAHEVRIKIEYTAVCHTDAYTLSGSDPEGLFPCVLGHEGAGIVESVGDDVITVKPGDHVIALYTAECGKCKFCTSGKTNLCGAVRATQGKGVMPDGTTRFHNAKGEDIYHFMGCSTFSEYTVVADVSVVAIDPKAPLDAACLLGCGVTTGFGAALKTANVQKGDTVAVFGCGTVGLSVIQGAKLRGASKIIAIDINNKKKQYCSQFGATDFVNPKEDLAKDQTIVEKLIEMTDGGLDFTFDCTGNTKIMRDALEACHKGWGQSIIIGVAAAGEEISTRPFQLVTGRVWKGSAFGGIKGRSEMGGLIKDYQKGALKVEEFITHRRPFKEINQAFEDLHNGDCLRTVLKSDEIK

SEQ ID NO: 1463 - protein, 370 aa, Saccharomyces cerevisiae
  source: /note="strain ATCC 204508 / S288c"
MAEASIEKTQILQKYLELDQRGRIIAEYVWIDGTGNLRSKGRTLKKRITSIDQLPEWNFDGSSTNQAPGHDSDIYLKPVAYYPDPFRRGDNIVVLAACYNNDGTPNKFNHRHEAAKLFAAHKDEEIWFGLEQEYTLFDMYDDVYGWPKGGYPAPQGPYYCGVGAGKVYARDMIEAHYRACLYAGLEISGINAEVMPSQWEFQVGPCTGIDMGDQLWMARYFLHRVAEEFGIKISFHPKPLKGDWNGAGCHTNVSTKEMRQPGGMKYIEQAIEKLSKRHAEHIKLYGSDNDMRLTGRHETASMTAFSSGVANRGSSIRIPRSVAKEGYGYFEDRRPASNIDPYLVTGIMCETVCGAIDNADMTKEFERESS

SEQ ID NO: 1464 - protein, 499 aa, Saccharomyces cerevisiae
  source: /note="strain ATCC 204508 / S288c"
MLRIRSLLNNKRAFSSTVRTLTINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 1465 - protein, 482 aa, Saccharomyces cerevisiae
  source: /note="strain ATCC 204508 / S288c"
MPDYDNYTTPLSSRYASKEMSATFSLRNRFSTWRKLWLNLAIAEKELGLTVVTDEAIEQMRKHVEITDDEIAKASAQEAIVRHDVMAHVHTFGETCPAAAGIIHLGATSCFVTDNADLIFIRDAYDIIIPKLVNVINRLAKFAMEYKDLPVLGWTHFQPAQLTTLGKRATLWIQELLWDLRNFERARNDIGLRGVKGTTGTQASFLALFHGNHDKVEALDERVTELLGFDKVYPVTGQTYSRKIDIDVLAPLSSFAATAHKMATDIRLLANLKEVEEPFEKSQIGSSAMAYKRNPMRCERVCSLARHLGSLFSDAVQTASVQWFERTLDDSAIRRISLPSAFLTADILLSTLLNISSGLVVYPKVIERRIKGELPFMATENIIMAMVEKNASRQEVHERIRVLSHQAAAVVKEEGGENDLIERVKRDEFFKPIWEELDSLLEPSTFVGRAPQQVEKFVQKDVNNALQPFQKYLNDEQVKLNV

SEQ ID NO: 1466 - protein, 506 aa, Saccharomyces cerevisiae
  source: /note="strain ATCC 204508 / S288c"
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPFHSNAKQDLAQIIELTRYYAGAVDKFNMGETIPLTFNKFAYTLKVPFGVVAQIVPWNYPLAMACRKMQGALAAGNTVIIKPAENTSLSLLYFATLIKKAGFPPGVVNVIPGYGSVVGKALGTHMDIDKISFTGSTKVGGSVLEASGQSNLKDITLECGGKSPALVFEDADLDKAIEWVANGIFFNSGQICTANSRVYVQSSIYDKFVEKFKETAKKEWDVAGKFDPFDEKCIVGPVISSTQYDRIKSYIERGKKEEKLDMFQTSEFPIGGAKGYFIPPTIFTDVPETSKLLRDEIFGPVVVVSKFTNYDDALKLANDTCYGLASAVFTKDVKKAHMFARDIKAGTVWINQTNQEEAKVPFGGFKMSGIGRESGDTGVDNYLQIKSVHVDLSLDK

SEQ ID NO: 1467 - protein, 507 aa, Saccharomyces cerevisiae
  source: /note="strain ATCC 204508 / S288c"
MTKSEQQADSRHNVIDLVGNTPLIALKKLPKALGIKPQIYAKLELYNPGGSIKDRIAKSMVEEAEASGRIHPSRSTLIEPTSGNTGIGLALIGAIKGYRTIITLPEKMSNEKVSVLKALGAEIIRTPTAAAWDSPESHIGVAKKLEKEIPGAVILDQYNNMMNPEAHYFGTGREIQRQLEDLNLFDNLRAVVAGAGTGGTISGISKYLKEQNDKIQIVGADPFGSILAQPENLNKTDITDYKVEGIGYDFVPQVLDRKLIDVWYKTDDKPSFKYARQLISNEGVLVGGSSGSAFTAVVKYCEDHPELTEDDVIVAIFPDSIRSYLTKFVDDEWLKKNNLWDDDVLARFDSSKLEASTTKYADVFGNATVKDLHLKPVVSVKETAKVTDVIKILKDNGFDQLPVLTEDGKLSGLVTLSELLRKLSINNSNNDNTIKGKYLDFKKLNNFNDVSSYNENKSGKKKFIKFDENSKLSDLNRFFEKNSSAVITDGLKPIHIVTKMDLLSYLA

SEQ ID NO: 1468 - protein, 592 aa, Saccharomyces cerevisiae
  source: /note="strain ATCC 204508 / S288c"
MALEPIDYTTHSREIDAEYLKIVRGSDPDTTWLIISPNAKKEYEPESTGSSFHDFLQLFDETKVQYGLARVSPPGSDVEKIIIIGWCPDSAPLKTRASFAANFAAVANNLFKGYHVQVTARDEDDLDENELLMKISNAAGARYSIQTSSKQQGKASTPPVKKSFTPSKSPAPVSKKEPVKTPSPAPAAKISSRVNDNNDDDDWNEPELKERDFDQAPLKPNQSSYKPIGKIDLQKVIAEEKAKEDPRLVQKPTAAGSKIDPSSDIANLKNESKLKRDSEFNSFLGTTKPPSMTESSLKNDDDKVIKGFRNEKSPAQLWAERKAKQNSGNAETKAEAPKPEVPEDEPEGEPDVKDLKSKFEGLAASEKEEEEMENKFAPPPKKSEPTIISPKPFSKPQEPVKAEEAEQPKTDYKKIGNPLPGMHIEADNEEEPEENDDDWDDDEDEAAQPPLPSRNVASGAPVQKEEPEQEEIAPSLPSRNSIPAPKQEEAPEQAPEEEIEEEAEEAAPQLPSRSSAAPPPPPRRATPEKKPKENPWATAEYDYDAAEDNELTFVENDKIINIEFVDDDWWLGELEKDGSKGLFPSNYVSLGN

SEQ ID NO: 1469 - protein, 589 aa, Saccharomyces cerevisiae
  source: /note="strain ATCC 204508 / S288c"
MTISSAHPETEPKWWKEATFYQIYPASFKDSNDDGWGDMKGIASKLEYIKELGADAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWKSYFGGSAWTFDEKTQEFYLRLFCSTQPDLNWENEDCRKAIYESAVGYWLDHGVDGFRIDVGSLYSKVVGLPDAPVVDKNSTWQSSDPYTLNGPRIHEFHQEMNQFIRNRVKDGREIMTVGEMQHASDETKRLYTSASRHELSELFNFSHTDVGTSPLFRYNLVPFELKDWKIALAELFRYINGTDCWSTIYLENHDQPRSITRFGDDSPKNRVISGKLLSVLLSALTGTLYVYQGQELGQINFKNWPVEKYEDVEIRNNYNAIKEEHGENSEEMKKFLEAIALISRDHARTPMQWSREEPNAGFSGPSAKPWFYLNDSFREGINVEDEIKDPNSVLNFWKEALKFRKAHKDITVYGYDFEFIDLDNKKLFSFTKKYNNKTLFAALNFSSDATDFKIPNDDSSFKLEFGNYPKKEVDASSRTLKPWEGRIYISE

SEQ ID NO: 1470 - protein, 635 aa, Saccharomyces cerevisiae
  source: /note="strain ATCC 204508 / S288c"
MKLENTLFTLGALGSISAALVIPNLENAADHHELINKEDHHERPRKVEFTKDDDEEPSDSEDKEHGKFHKKGRKGQDKESPEFNGKRASGSHGSAHEGGKGMKPKHESSNDDDNDDKKKKPHHKGGCHENKVEEKKMKGKKVKGKKHHEKTLEKGRHHNRLAPLVSTAQFNPDAISKIIPNRYIIVFKRGAPQEEIDFHKENVQQAQLQSVENLSAEDAFFISTKDTSLSTSEAGGIQDSFNIDNLFSGYIGYFTQEIVDLIRQNPLVDFVERDSIVEATEFDTQNSAPWGLARISHRERLNLGSFNKYLYDDDAGRGVTSYVIDTGVNINHKDFEKRAIWGKTIPLNDEDLDGNGHGTHCAGTIASKHYGVAKNANVVAVKVLRSNGSGTMSDVVKGVEYAAKAHQKEAQEKKKGFKGSTANMSLGGGKSPALDLAVNAAVEVGIHFAVAAGNENQDACNTSPASADKAITVGASTLSDDRAYFSNWGKCVDVFAPGLNILSTYIGSDDATATLSGTSMASPHVAGLLTYFLSLQPGSDSEFFELGQDSLTPQQLKKKLIHYSTKDILFDIPEDTPNVLIYNGGGQDLSAFWNDTKKSHSSGFKQELNMDEFIGSKTDLIFDQVRDILDKLNII

SEQ ID NO: 1471 - protein, 683 aa, Saccharomyces cerevisiae
  source: /note="strain ATCC 204508 / S288c"
MTIKEHKVVYEAHNVKALKAPQHFYNSQPGKGYVTDMQHYQEMYQQSINEPEKFFDKMAKEYLHWDAPYTKVQSGSLNNGDVAWFLNGKLNASYNCVDRHAFANPDKPALIYEADDESDNKIITFGELLRKVSQIAGVLKSWGVKKGDTVAIYLPMIPEAVIAMLAVARIGAIHSVVFAGFSAGSLKDRVVDANSKVVITCDEGKRGGKTINTKKIVDEGLNGVDLVSRILVFQRTGTEGIPMKAGRDYWWHEEAAKQRTYLPPVSCDAEDPLFLLYTSGSTGSPKGVVHTTGGYLLGAALTTRYVFDIHPEDVLFTAGDVGWITGHTYALYGPLTLGTASIIFESTPAYPDYGRYWRIIQRHKATHFYVAPTALRLIKRVGEAEIAKYDTSSLRVLGSVGEPISPDLWEWYHEKVGNKNCVICDTMWQTESGSHLIAPLAGAVPTKPGSATVPFFGINACIIDPVTGVELEGNDVEGVLAVKSPWPSMARSVWNHHDRYMDTYLKPYPGHYFTGDGAGRDHDGYYWIRGRVDDVVNVSGHRLSTSEIEASISNHENVSEAAVVGIPDELTGQTVVAYVSLKDGYLQNNATEGDAEHITPDNLRRELILQVRGEIGPFASPKTIILVRDLPRTRSGKIMRRVLRKVASNEAEQLGDLTTLANPEVVPAIISAVENQFFSQKKK

SEQ ID NO: 1472 - protein, 779 aa, Saccharomyces cerevisiae
  source: /note="strain ATCC 204508 / S288c"
MVYTPSKGPRTLYDKVFDAHVVHQDENGSFLLYIDRHLVHEVTSPQAFEGLENAGRKVRRVDCTLATVDHNIPTESRKNFKSLDTFIKQTDSRLQVKTLENNVKQFGVPYFGMSDARQGIVHTIGPEEGFTLPGTTVVCGDSHTSTHGAFGSLAFGIGTSEVEHVLATQTIIQAKSKNMRITVNGKLSPGITSKDLILYIIGLIGTAGGTGCVIEFAGEAIEALSMEARMSMCNMAIEAGARAGMIKPDETTFQYTKGRPLAPKGAEWEKAVAYWKTLKTDEGAKFDHEINIEAVDVIPTITWGTSPQDALPITGSVPDPKNVTDPIKKSGMERALAYMGLEPNTPLKSIKVDKVFIGSCTNGRIEDLRSAAAVVRGQKLASNIKLAMVVPGSGLVKKQAEAEGLDKIFQEAGFEWREAGCSICLGMNPDILDAYERCASTSNRNFEGRQGALSRTHLMSPAMAAAAGIAGHFVDIREFEYKDQDQSSPKVEVTSEDEKELESAAYDHAEPVQPEDAPQDIANDELKDIPVKSDDTPAKPSSSGMKPFLTLEGISAPLDKANVDTDAIIPKQFLKTIKRTGLKKGLFYEWRFRKDDQGKDQETDFVLNVEPWREAEILVVTGDNFGCGSSREHAPWALKDFGIKSIIAPSYGDIFYNNSFKNGLLPIRLDQQIIIDKLIPIANKGGKLCVDLPNQKILDSDGNVLVDHFEIEPFRKHCLVNGLDDIGITLQKEEYISRYEALRREKYSFLEGGSKLLKFDNVPKRKAVTTTFDKVHQDW

SEQ ID NO: 1473 - protein, 811 aa, Saccharomyces cerevisiae
  source: /note="strain ATCC 204508 / S288c"
MLRQATKAPIQKYLQRTQLLRRSTPRIYTIVQCKRSICSFNARPRVANKLLSDIKTNALNEVAISTCALKSSYGLPNFKRTYVQMRMDPNQQPEKPALEQFGTNLTKLARDGKLDPVIGRDEEIARAIQILSRRTKNNPCLIGRAGVGKTALIDGLAQRIVAGEVPDSLKDKDLVALDLGSLIAGAKYRGEFEERLKKVLEEIDKANGKVIVFIDEVHMLLGLGKTDGSMDASNILKPKLARGLRCISATTLDEFKIIEKDPALSRRFQPILLNEPSVSDTISILRGLKERYEVHHGVRITDTALVSAAVLSNRYITDRFLPDKAIDLVDEACAVLRLQHESKPDEIQKLDRAIMKIQIELESLKKETDPVSVERREALEKDLEMKNDELNRLTKIWDAERAEIESIKNAKANLEQARIELEKCQREGDYTKASELRYSRIPDLEKKVALSEKSKDGDKVNLLHDSVTSDDISKVVAKMTGIPTETVMKGDKDRLLYMENSLKERVVGQDEAIAAISDAVRLQRAGLTSEKRPIASFMFLGPTGTGKTELTKALAEFLFDDESNVIRFDMSEFQEKHTVSRLIGAPPGYVLSESGGQLTEAVRRKPYAVVLFDEFEKAHPDVSKLLLQVLDEGKLTDSLGHHVDFRNTIIVMTSNIGQDILLNDTKLGDDGKIDTATKNKVIEAMKRSYPPEFINRIDDILVFNRLSKKVLRSIVDIRIAEIQDRLAEKRMKIDLTDEAKDWLTDKGYDQLYGARPLNRLIHRQILNSMATFLLKGQIRNGETVRVVVKDTKLVVLPNHEEGEVVEEEAEK

SEQ ID NO: 1474 - protein, 62 aa, Saccharomyces cerevisiae; identical to SEQ ID NO: 549
  source: /note="strain ATCC 204508 / S288c"

SEQ ID NO: 1475 - protein, 75 aa, Saccharomyces cerevisiae
  source: /note="strain ATCC 204508 / S288c"
MTKNFIVTLKKNTPDVEAKKFLDSVHHAGGSIVHEFDIIKGYTIKVPDVLHLNKLKEKHNDVIENVEEDKEVHTN

SEQ ID NO: 1476 - protein, 92 aa, Saccharomyces cerevisiae; identical to SEQ ID NO: 639
  source: /note="strain ATCC 204508 / S288c"

SEQ ID NO: 1477 - protein, 105 aa, Saccharomyces cerevisiae
  source: /note="strain ATCC 204508 / S288c"
MAPVKSQESINQKLALVIKSGKYTLGYKSTVKSLRQGKSKLIIIAANTPVLRKSELEYYAMLSKTKVYYFQGGNNELGTAVGKLFRVGVVSILEAGDSDILTTLA

SEQ ID NO: 1478 - protein, 110 aa, Saccharomyces cerevisiae
  source: /note="strain ATCC 204508 / S288c"
MVSQETIKHVKDLIAENEIFVASKTYCPYCHAALNTLFEKLKVPRSKVLVLQLNDMKEGADIQAALYEINGQRTVPNIYINGKHIGGNDDLQELRETGELEELLEPILAN

SEQ ID NO: 1479 - protein, 108 aa, Saccharomyces cerevisiae; identical to SEQ ID NO: 634
  source: /note="strain ATCC 204508 / S288c"

SEQ ID NO: 1480 - protein, 129 aa, Saccharomyces cerevisiae
  source: /note="strain ATCC 204508 / S288c"
MVTTLTPVICESAPAAAASYSHAMKVNNLIFLSGQIPVTPDNKLVEGSIADKAEQVIQNIKNVLEASNSSLDRVVKVNIFLADINHFAEFNSVYAKYFNTHKPARSCVAVAALPLGVDMEMEAIAAERD

SEQ ID NO: 1481 - protein, 125 aa, Saccharomyces cerevisiae
  source: /note="strain ATCC 204508 / S288c"
MFRSVCRISSRVAPSAYRTIMGRSVMSNTILAQRFYSANLSKDQVSQRVIDVIKAFDKNSPNIANKQISSDTQFHKDLGLDSLDTVELLVAIEEEFDIEIPDKVADELRSVGETVDYIASNPDAN

SEQ ID NO: 1482 - protein, 127 aa, Saccharomyces cerevisiae
  source: /note="strain ATCC 204508 / S288c"
MPQSFTSIARIGDYILKSPVLSKLCVPVANQFINLAGYKKLGLKFDDLIAEENPIMQTALRRLPEDESYARAYRIIRAHQTELTHHLLPRNEWIKAQEDVPYLLPYILEAEAAAKEKDELDNIEVSK

SEQ ID NO: 1483 - protein, 144 aa, Saccharomyces cerevisiae
  source: /note="strain ATCC 204508 / S288c"
MAGVSVRDVAAQDFINAYASFLQRQGKLEVPGYVDIVKTSSGNEMPPQDAEGWFYKRAASVARHIYMRKQVGVGKLNKLYGGAKSRGVRPYKHIDASGSINRKVLQALEKIGIVEISPKGGRRISENGQRDLDRIAAQTLEEDE

SEQ ID NO: 1484 - protein, 142 aa, Saccharomyces cerevisiae
  source: /note="strain ATCC 204508 / S288c"
MAPSAKATAAKKAVVKGTNGKKALKVRTSATFRLPKTLKLARAPKYASKAVPHYNRLDSYKVIEQPITSETAMKKVEDGNILVFQVSMKANKYQIKKAVKELYEVDVLKVNTLVRPNGTKKAYVRLTADYDALDIANRIGYI

SEQ ID NO: 1485 - protein, 150 aa, Saccharomyces cerevisiae; identical to SEQ ID NO: 546
  source: /note="strain ATCC 204508 / S288c"

SEQ ID NO: 1486 - protein, 151 aa, Saccharomyces cerevisiae
  source: /note="strain ATCC 204508 / S288c"
MGRMHSAGKGISSSAIPYSRNAPAWFKLSSESVIEQIVKYARKGLTPSQIGVLLRDAHGVTQARVITGNKIMRILKSNGLAPEIPEDLYYLIKKAVSVRKHLERNRKDKDAKFRLILIESRIHRLARYYRTVAVLPPNWKYESATASALVN

SEQ ID NO: 1487 - protein, 170 aa, Saccharomyces cerevisiae
  source: /note="strain ATCC 204508 / S288c"
MLRTTRLWTTRMPTVSKLFLRNSSGNALNKNKLPFLYSSQGPQAVRYTSQHEWIAVHQDKTAFVGITKYATDALGDATYVELPEVGTEIAQGESLGSIESVKSASEIYQPADGTVEEINTNLEENPGVVNEDPMGDGWLVKMKLGEGVNVEQVEGLMSLEQYEKTLVHDD

SEQ ID NO: 1488 - protein, 173 aa, Saccharomyces cerevisiae
  source: /note="strain ATCC 204508 / S288c"
MTHSLKALFALLFLYTAAVNAGVIGIFNALPPPNTKPINGESPLYQCDILDKQLVEIKEVNLDPNPPVRGENLTISANGEVFETIEEGAYIDVEVRLGYIRLLSQTFDLCETLEDNDIEGLSCPIEPGEYNIKKIVEIPGEVPPGKYVVVARAYTEKDDLITCLTGEVIFPPR

SEQ ID NO: 1489 - protein, 161 aa, Saccharomyces cerevisiae
  source: /note="strain ATCC 204508 / S288c"
MTKKDKKEVKVQTVTTEDGETVKVFEDLQGFETFIANETEDDDFDHLHCKLNYYPPFVLHESHEDPEKISDAANSHSKKFVRHLHQHIEKHLLKDIKQAVRKPELKFHEKSKEETFDKITWHYGEETEYHGRPFKIDVQVVCTHEDAMVFVDYKTHPVGAN

SEQ ID NO: 1490 - protein, 268 aa, Saccharomyces cerevisiae; identical to SEQ ID NO: 610
  source: /note="strain ATCC 204508 / S288c"

SEQ ID NO: 1491 - protein, 309 aa, Saccharomyces cerevisiae
  source: /note="strain ATCC 204508 / S288c"
MIFKRFVNLLVFLFLLGAGLLTFFLILSGGRESGTLKNFYWLQADTNGFNSAPSTTRWYNYNWCGYEDGQLANCSSRAPAKPFSPRDNFGNSVNLPSSFRNNRDTYYYLSRVGWAMLLISLFFIVLALVPGFLATFLPFKAVPVLYCVLSWLAFFFIILAACLYTGCYVKARKTFRNSGRSARLGPKNFAFIWTSVFLMLVNAIWSTIFSATHKAHSTYSDHDMYAQYESPSVDTGAQMEKSTYNSGATDGAGPITAAPVVGQPQPTTTTTPAGNGKFFQKLKTRKQVPSAELEPAGDGGLAGPVTVRD

SEQ ID NO: 1492 - protein, 312 aa, Saccharomyces cerevisiae
  source: /note="strain ATCC 204508 / S288c"
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 1493 - protein, 326 aa, Saccharomyces cerevisiae
  source: /note="strain ATCC 204508 / S288c"
MSTDSTRYPIQIEKASNDPTLLLNHTCLRVKDPARTVKFYTEHFGMKLLSRKDFEEAKFSLYFLSFPKDDIPKNKNGEPDVFSAHGVLELTHNWGTEKNPDYKINNGNEEPHRGFGHICFSVSDINKTCEELESQGVKFKKRLSEGRQKDIAFALGPDGYWIELITYSREGQEYPKGSVGNKFNHTMIRIKNPTRSLEFYQNVLGMKLLRTSEHESAKFTLYFLGYGVPKTDSVFSCESVLELTHNWGTENDPNFHYHNGNSEPQGYGHICISCDDAGALCKEIEVKYGDKIQWSPKFNQGRMKNIAFLKDPDGYSIEVVPHGLIA

SEQ ID NO: 1494 - protein, 364 aa, Saccharomyces cerevisiae
  source: /note="strain ATCC 204508 / S288c"
MSAPKKIVVLPGDHVGQEITAEAIKVLKAISDVRSNVKFDFENHLIGGAAIDATGVPLPDEALEASKKADAVLLGAVGGPKWGTGSVRPEQGLLKIRKELQLYANLRPCNFASDSLLDLSPIKPQFAKGTDFVVVRELVGGIYFGKRKEDDGDGVAWDSEQYTVPEVQRITRMAAFMALQHEPPLPIWSLDKANVLASSRLWRKTVEETIKNEFPTLKVQHQLIDSAAMILVKNPTHLNGIIITSNMFGDIISDEASVIPGSLGLLPSASLASLPDKNTAFGLYEPCHGSAPDLPKNKVNPIATILSAAMMLKLSLNLPEEGKAIEDAVKKVLDAGIRTGDLGGSNSTTEVGDAVAEEVKKILA

SEQ ID NO: 1495 - protein, 345 aa, Saccharomyces cerevisiae
  source: /note="strain ATCC 204508 / S288c"
MEAHNQFLKTFQKERHDMKEAEKDEILLMENSRRFVMFPIKYHEIWAAYKKVEASFWTAEEIELAKDTEDFQKLTDDQKTYIGNLLALSISSDNLVNKYLIENFSAQLQNPEGKSFYGFQIMMENIYSEVYSMMVDAFFKDPKNIPLFKEIANLPEVKHKAAFIERWISNDDSLYAERLVAFAAKEGIFQAGNYASMFWLTDKKIMPGLAMANRNICRDRGAYTDFSCLLFAHLRTKPNPKIIEKIITEAVEIEKEYYSNSLPVEKFGMDLKSIHTYIEFVADGLLQGFGNEKYYNAVNPFEFMEDVATAGKTTFFEKKVSDYQKASDMSKSATPSKEINFDDDF

SEQ ID NO: 1496 - protein, 371 aa, Saccharomyces cerevisiae
  source: /note="strain ATCC 204508 / S288c"
MFRSVATRLSACRGLASNAARKSLTIGLIPGDGIGKEVIPAGKQVLENLNSKHGLSFNFIDLYAGFQTFQETGKALPDETVKVLKEQCQGALFGAVQSPTTKVEGYSSPIVALRREMGLFANVRPVKSVEGEKGKPIDMVIVRENTEDLYIKIEKTYIDKATGTRVADATKRISEIATRRIATIALDIALKRLQTRGQATLTVTHKSNVLSQSDGLFREICKEVYESNKDKYGQIKYNEQIVDSMVYRLFREPQCFDVIVAPNLYGDILSDGAAALVGSLGVVPSANVGPEIVIGEPCHGSAPDIAGKGIANPIATIRSTALMLEFLGHNEAAQDIYKAVDANLREGSIKTPDLGGKASTQQVVDDVLSRL

SEQ ID NO: 1497 - protein, 352 aa, Saccharomyces cerevisiae
  source: /note="strain ATCC 204508 / S288c"
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 1498 - protein, 353 aa, Saccharomyces cerevisiae
  source: /note="strain ATCC 204508 / S288c"
MGSQDLASLIGRFKYVRVLDSNPHTKVISLLGSIDGKDAVLTAEKTHFIFDETVRRPSQSGRSTPIFFHREIDEYSFLNGITDLKELTSNDIYYWGLSVLKQHILHNPTAKVNLIWPASQFHIKGYDQQDLHVVRETPDMYRNIVVPFIQEMCTSERMKWVNNILYEGAEDDRVVYKEYSSRNKEDGFVILPDMKWDGINIDSLYLVAIVYRDDIKSLRDLNPNHRDWLIRLNKKIKTIIPQHYDYNVNPDELRVFIHYQPSYYHFHVHIVNIRHPGVGEERGSGMTILLEDVIEALGFLGPEGYMKKTLTYVIGENHDLWKKGFKEEVEKQLKHDGIATSPEKGSGFNTNLG

SEQ ID NO: 1499 - protein, 375 aa, Saccharomyces cerevisiae
  source: /note="strain ATCC 204508 / S288c"
MSFYQPSLSLYDVLNALSNQTGQRGQQGYPRQPQRPQRYHPHYGQVHVGGHHPRHHPLYSRYNGVPNTYYYQFPGQAYYYSPEYGYDDEDGEEEDQDEDMVGDSGTTRQEDGGEDSNSRRYPSYYHCNTARNNRTNQQANSLNDLLTALIGVPPYEGTEPEIEANTEQEGEKGEEKDKKDKSEAPKEEAGETNKEKPLNQLEESSRPPLAKKSSSFAHLQAPSPIPDPLQVSKPETRMDLPFSPEVNVYDTEDTYVVVLALPGANSRAFHIDYHPSSHEMLIKGKIEDRVGIDEKFLKITELKYGAFERTVKFPVLPRIKDEEIKATYNNGLLQIKVPKIVNDTEKPKPKKRIAIEEIPDEELEFEENPNPTVEN

SEQ ID NO: 1500 - protein, 394 aa, Saccharomyces cerevisiae
  source: /note="strain ATCC 204508 / S288c"
MPPKKQVEEKKVLLGRPGNNLKAGIVGLANVGKSTFFQAITRCPLGNPANYPFATIDPEEARVIVPSPRFDKLCEIYKKTASEVPAHLTVYDIAGLTKGASAGEGLGNAFLSHIRSVDSIYQVVRCFDDAEIIHVEGDVDPVRDLEIINQELRLKDIEFAQKALEGAEKIAKRGGQSLEVKQKKEEMDLITKIIKLLESGQRVANHSWTSKEVEIINSMFLLTAKPCIYLINLSERDYIRKKNKHLLRIKEWVDKYSPGDLIIPFSVSLEERLSHMSPEDAEEELKKLQTISALPKIITTMRQKLDLISFFTCGPDEVREWTIRRGTKAPQAAGVIHNDLMNTFILAQVMKCEDVFEYKDDSAIKAAGKLMQKGKDYVVEDGDIIYFRAGAGKN

SEQ ID NO: 1501 - protein, 393 aa, Saccharomyces cerevisiae
  source: /note="strain ATCC 204508 / S288c"
MLQRHSLKLGKFSIRTLATGAPLDASKLKITRNPNPSKPRPNEELVFGQTFTDHMLTIPWSAKEGWGTPHIKPYGNLSLDPSACVFHYAFELFEGLKAYRTPQNTITMFRPDKNMARMNKSAARICLPTFESEELIKLTGKLIEQDKHLVPQGNGYSLYIRPTMIGTSKGLGVGTPSEALLYVITSPVGPYYKTGFKAVRLEATDYATRAWPGGVGDKKLGANYAPCILPQLQAAKRGYQQNLWLFGPEKNITEVGTMNVFFVFLNKVTGKKELVTAPLDGTILEGVTRDSVLTLARDKLDPQEWDINERYYTITEVATRAKQGELLEAFGSGTAAVVSPIKEIGWNNEDIHVPLLPGEQCGALTKQVAQWIADIQYGRVNYGNWSKTVADLN

SEQ ID NO: 1502 - protein, 399 aa, Saccharomyces cerevisiae
  source: /note="strain ATCC 204508 / S288c"
MPKETPSKAAADALSDLEIKDSKSNLNKELETLREENRVKSDMLKEKLSKDAENHKAYLKSHQVHRHKLKEMEKEEPLLNEDKERTVLFPIKYHEIWQAYKRAEASFWTAEEIDLSKDIHDWNNRMNENERFFISRVLAFFAASDGIVNENLVENFSTEVQIPEAKSFYGFQIMIENIHSETYSLLIDTYIKDPKESEFLFNAIHTIPEIGEKAEWALRWIQDADALFGERLVAFASIEGVFFSGSFASIFWLKKRGMMPGLTFSNELICRDEGLHTDFACLLFAHLKNKPDPAIVEKIVTEAVEIEQRYFLDALPVALLGMNADLMNQYVEFVADRLLVAFGNKKYYKVENPFDFMENISLAGKTNFFEKRVSDYQKAGVMSKSTKQEAGAFTFNEDF

SEQ ID NO: 1503 - protein, 424 aa, Saccharomyces cerevisiae
  source: /note="strain ATCC 204508 / S288c"
MSEATLSSKQTIEWENKYSAHNYHPLPVVFHKAKGAHVWDPEGKLYLDFLSAYSAVNQGHCHPHIIKALTEQAQTLTLSSRAFHNDVYAQFAKFVTEFFGFETVLPMNTGAEAVETALKLARRWGYMKKNIPQDKAIILGAEGNFHGRTFGAISLSTDYEDSKLHFGPFVPNVASGHSVHKIRYGHAEDFVPILESPEGKNVAAIILEPIQGEAGIVVPPADYFPKVSALCRKHNVLLIVDEIQTGIGRTGELLCYDHYKAEAKPDIVLLGKALSGGVLPVSCVLSSHDIMSCFTPGSHGSTFGGNPLASRVAIAALEVIRDEKLCQRAAQLGSSFIAQLKALQAKSNGIISEVRGMGLLTAIVIDPSKANGKTAWDLCLLMKDHGLLAKPTHDHIIRLAPPLVISEEDLQTGVETIAKCIDLL

SEQ ID NO: 1504 - protein, 429 aa, Saccharomyces cerevisiae
  source: /note="strain ATCC 204508 / S288c"
MSNKLFRLDAGYQQYDWGKIGSSSAVAQFAAHSDPSVQIEQDKPYAELWMGTHSKMPSYNHESKESLRDIISKNPSAMLGKDIIDKFHATNELPFLFKVLSIEKVLSIQAHPDKALGKILHAQDPKNYPDDNHKPEMAIAVTDFEGFCGFKPLQEIADELKRIPELRNIVGEETSRNFIENIQPSAQKGSPEDEQNKKLLQAVFSRVMNASDDKIKIQARSLVERSKNSPSDFNKPDLPELIQRLNKQFPDDVGLFCGCLLLNHCRLNAGEAIFLRAKDPHAYISGDIMECMAASDNVVRAGFTPKFKDVKNLVSMLTYTYDPVEKQKMQPLKFDRSSGNGKSVLYNPPIEEFAVLETTFDEKLGQRHFEGVDGPSILITTKGNGYIKADGQKLKAEPGFVFFIAPHLPVDLEAEDEAFTTYRAFVEPN

SEQ ID NO: 1505 - protein, 469 aa, Saccharomyces cerevisiae
  source: /note="strain ATCC 204508 / S288c"
MTSIDINNLQNTFQQAMNMSGSPGAVCTSPTQSFMNTVPQRLNAVKHPKILKPFSTGDMKILLLENVNQTAITIFEEQGYQVEFYKSSLPEEELIEKIKDVHAIGIRSKTRLTSNVLQHAKNLVCIGCFCIGTNQVDLDYATSRGIAVFNSPFSNSRSVAELVIAEIISLARQLGDRSIELHTGTWNKVAARCWEVRGKTLGIIGYGHIGSQLSVLAEAMGLHVLYYDIVTIMALGTARQVSTLDELLNKSDFVTLHVPATPETEKMLSAPQFAAMKDGAYVINASRGTVVDIPSLIQAVKANKIAGAALDVYPHEPAKNGEGSFNDELNSWTSELVSLPNIILTPHIGGSTEEAQSSIGIEVATALSKYINEGNSVGSVNFPEVALKSLSYDQENTVRVLYIHQNVPGVLKTVNDILSNHNIEKQFSDSNGEIAYLMADISSVDQSDIKDIYEQLNQTSAKISIRLLY

SEQ ID NO: 1506 - protein, 527 aa, Saccharomyces cerevisiae [sequence omitted]

SEQ ID NO: 1507 - protein, 511 aa, Saccharomyces cerevisiae
  source: /note="strain ATCC 204508 / S288c"
MPAPHGGILQDLIARDALKKNELLSEAQSSDILVWNLTPRQLCDIELILNGGFSPLTGFLNENDYSSVVTDSRLADGTLWTIPITLDVDEAFANQIKPDTRIALFQDDEIPIAILTVQDVYKPNKTIEAEKVFRGDPEHPAISYLFNVAGDYYVGGSLEAIQLPQHYDYPGLRKTPAQLRLEFQSRQWDRVVAFQTRNPMHRAHRELTVRAAREANAKVLIHPVVGLTKPGDIDHHTRVRVYQEIIKRYPNGIAFLSLLPLAMRMSGDREAVWHAIIRKNYGASHFIVGRDHAGPGKNSKGVDFYGPYDAQELVESYKHELDIEVVPFRMVTYLPDEDRYAPIDQIDTTKTRTLNISGTELRRRLRVGGEIPEWFSYPEVVKILRESNPPRPKQGFSIVLGNSLTVSREQLSIALLSTFLQFGGGRYYKIFEHNNKTELLSLIQDFIGSGSGLIIPNQWEDDKDSVVGKQNVYLLDTSSSADIQLESADEPISHIVQKVVLFLEDNGFFVF

SEQ ID NO: 1508 - protein, 619 aa, Saccharomyces cerevisiae
  source: /note="strain ATCC 204508 / S288c"
MVKESIIALAEHAASRASRVIPPVKLAYKNMLKDPSSKYKPFNAPKLSNRKWPDNRITRAPRWLSTDLRDGNQSLPDPMSVEQKKEYFHKLVNIGFKEIEVSFPSASQTDFDFTRYAVENAPDDVSIQCLVQSREHLIKRTVEALTGAKKATIHTYLATSDMFREIVFNMSREEAISKAVEATKLVRKLTKDDPSQQATRWSYEFSPECFSDTPGEFAVEICEAVKKAWEPTEENPIIFNLPATVEVASPNVYADQIEYFATHITEREKVCISTHCHNDRGCGVAATELGMLAGADRVEGCLFGNGERTGNVDLVTVAMNMYTQGVSPNLDFSDLTSVLDVVERCNKIPVSQRAPYGGDLVVCAFSGSHQDAIKKGFNLQNKKRAQGETQWRIPYLPLDPKDIGRDYEAVIRVNSQSGKGGAAWVILRSLGLDLPRNMQIEFSSAVQDHADSLGRELKSDEISKLFKEAYNYNDEQYQAISLVNYNVEKFGTERRVFTGQVKVGDQIVDIEGTGNGPISSLVDALSNLLNVRFAVANYTEHSLGSGSSTQAASYIHLSYRRNADNEKAYKWGVGVSEDVGDSSVRAIFATINNIIHSGDVSIPSLAEVEGKNAAASGSA

SEQ ID NO: 1509 - protein, 708 aa, Saccharomyces cerevisiae
  source: /note="strain ATCC 204508 / S288c"
MPSTLTINGKAPIVAYAELIAARIVNALAPNSIAIKLVDDKKAPAAKLDDATEDVFNKITSKFAAIFDNGDKEQVAKWVNLAQKELVIKNFAKLSQSLETLDSQLNLRTFILGGLKYSAADVACWGALRSNGMCGSIIKNKVDVNVSRWYTLLEMDPIFGEAHDFLSKSLLELKKSANVGKKKETHKANFEIDLPDAKMGEVVTRFPPEPSGYLHIGHAKAALLNQYFAQAYKGKLIIRFDDTNPSKEKEEFQDSILEDLDLLGIKGDRITYSSDYFQEMYDYCVQMIKDGKAYCDDTPTEKMREERMDGVASARRDRSVEENLRIFTEEMKNGTEEGLKNCVRAKIDYKALNKTLRDPVIYRCNLTPHHRTGSTWKIYPTYDFCVPIVDAIEGVTHALRTIEYRDRNAQYDWMLQALRLRKVHIWDFARINFVRTLLSKRKLQWMVDKDLVGNWDDPRFPTVRGVRRRGMTVEGLRNFVLSQGPSRNVINLEWNLIWAFNKKVIDPIAPRHTAIVNPVKIHLEGSEAPQEPKIEMKPKHKKNPAVGEKKVIYYKDIVVDKDDADVINVDEEVTLMDWGNVIITKKNDDGSMVAKLNLEGDFKKTKHKLTWLADTKDVVPVDLVDFDHLITKDRLEEDESFEDFLTPQTEFHTDAIADLNVKDMKIGDIIQFERKGYYRLDALPKDGKPYVFFTIPDGKSVNKYGAKK

SEQ ID NO: 1510 - protein, 734 aa, Saccharomyces cerevisiae
  source: /note="strain ATCC 204508 / S288c"
MSASEAGVTEQVKKLSVKDSSNDAVKPNKKENKKSKQQSLYLDPEPTFIEERIEMFDRLQKEYNDKVASMPRVPLKIVLKDGAVKEATSWETTPMDIAKGISKSLADRLCISKVNGQLWDLDRPFEGEANEEIKLELLDFESDEGKKVFWHSSAHVLGESCECHLGAHICLGPPTDDGFFYEMAVRDSMKDISESPERTVSQADFPGLEGVAKNVIKQKQKFERLVMSKEDLLKMFHYSKYKTYLVQTKVPDGGATTVYRCGKLIDLCVGPHIPHTGRIKAFKLLKNSSCYFLGDATNDSLQRVYGISFPDKKLMDAHLKFLAEASMRDHRKIGKEQELFLFNEMSPGSCFWLPHGTRIYNTLVDLLRTEYRKRGYEEVITPNMYNSKLWETSGHWANYKENMFTFEVEKETFGLKPMNCPGHCLMFKSRERSYRELPWRVADFGVIHRNEFSGALSGLTRVRRFQQDDAHIFCTHDQIESEIENIFNFLQYIYGVFGFEFKMELSTRPEKYVGKIETWDAAESKLESALKKWGGNWEINAGDGAFYGPKIDIMISDALRRWHQCATIQLDFQLPNRFELEFKSKDQDSESYERPVMIHRAILGSVERMTAILTEHFAGKWPFWLSPRQVLVVPVGVKYQGYAEDVRNKLHDAGFYADVDLTGNTLQKKVRNGQMLKYNFIFIVGEQEMNEKSVNIRNRDVMEQQGKNATVSVEEVLKQLRNLKDEKRGDNVLA

SEQ ID NO: 1511 - protein, 799 aa, Saccharomyces cerevisiae
  source: /note="strain ATCC 204508 / S288c"
MVLPILPLIDDLASWNSKKEYVSLVGQVLLDGSSLSNEEILQFSKEEEVPLVALSLPSGKFSDDEIIAFLNNGVSSLFIASQDAKTAEHLVEQLNVPKERVVVEENGVFSNQFMVKQKFSQDKIVSIKKLSKDMLTKEVLGEVRTDRPDGLYTTLVVDQYERCLGLVYSSKKSIAKAIDLGRGVYYSRSRNEIWIKGETSGNGQKLLQISTDCDSDALKFIVEQENVGFCHLETMSCFGEFKHGLVGLESLLKQRLQDAPEESYTRRLFNDSALLDAKIKEEAEELTEAKGKKELSWEAADLFYFALAKLVANDVSLKDVENNLNMKHLKVTRRKGDAKPKFVGQPKAEEEKLTGPIHLDVVKASDKVGVQKALSRPIQKTSEIMHLVNPIIENVRDKGNSALLEYTEKFDGVKLSNPVLNAPFPEEYFEGLTEEMKEALDLSIENVRKFHAAQLPTETLEVETQPGVLCSRFPRPIEKVGLYIPGGTAILPSTALMLGVPAQVAQCKEIVFASPPRKSDGKVSPEVVYVAEKVGASKIVLAGGAQAVAAMAYGTETIPKVDKILGPGNQFVTAAKMYVQNDTQALCSIDMPAGPSEVLVIADEDADVDFVASDLLSQAEHGIDSQVILVGVNLSEKKIQEIQDAVHNQALQLPRVDIVRKCIAHSTIVLCDGYEEALEMSNQYAPEHLILQIANANDYVKLVDNAGSVFVGAYTPESCGDYSSGTNHTLPTYGYARQYSGANTATFQKFITAQNITPEGLENIGRAVMCVAKKEGLDGHRNAVKIRMSKLGLIPKDFQ

SEQ ID NO: 1512 - protein, 1002 aa, Saccharomyces cerevisiae
  source: /note="strain ATCC 204508 / S288c"
MAKKSKKNQQNYWDEEFEEDAAQNEEISATPTPNPESSAGADDTSREASASAEGAEAIEGDFMSTLKQSKKKQEKKVIEEKKDGKPILKSKKEKEKEKKEKEKQKKKEQAARKKAQQQAQKEKNKELNKQNVEKAAAEKAAAEKSQKSKGESDKPSASAKKPAKKVPAGLAALRRQLELKKQLEEQEKLEREEEERLEKEEEERLANEEKMKEEAKAAKKEKEKAKREKRKAEGKLLTRKQKEEKKLLERRRAALLSSGNVKVAGLAKKDGEENKPKKVVYSKKKKRTTQENASEAIKSDSKKDSEVVPDDELKESEDVLIDDWENLALGDDDEEGTNEETQESTASHENEDQNQGEEEEEGEEEEEEEEERAHVHEVAKSTPAATPAATPTPSSASPNKKDLRSPICCILGHVDTGKTKLLDKIRQTNVQGGEAGGITQQIGATYFPIDAIKAKTKVMAEYEKQTFDVPGLLVIDTPGHESFSNLRSRGSSLCNIAILVIDIMHGLEQQTIESIKLLRDRKAPFVVALNKIDRLYDWKAIPNNSFRDSFAKQSRAVQEEFQSRYSKIQLELAEQGLNSELYFQNKNMSKYVSIVPTSAVTGEGVPDLLWLLLELTQKRMSKQLMYLSHVEATILEVKVVEGFGTTIDVILSNGYLREGDRIVLCGMNGPIVTNIRALLTPQPLRELRLKSEYVHHKEVKAALGVKIAANDLEKAVSGSRLLVVGPEDDEDELMDDVMDDLTGLLDSVDTTGKGVVVQASTLGSLEALLDFLKDMKIPVMSIGLGPVYKRDVMKASTMLEKAPEYAVMLCFDVKVDKEAEQYAEQEGIKIFNADVIYHLFDSFTAYQEKLLEERRKDFLDYAIFPCVLQTLQIINKRGPMIIGVDVLEGTLRVGTPICAVKTDPTTKERQTLILGKVISLEINHQPVQEVKKGQTAAGVAVRLEDPSGQQPIWGRHVDENDTLYSLVSRRSIDTLKDKAFRDQVARSDWLLLKKLKVVFGIE

SEQ ID NO: 1513 - protein, 1024 aa, Saccharomyces cerevisiae
  source: /note="strain ATCC 204508 / S288c"
MSSNNSGLSAAGEIDESLYSRQLYVLGKEAMLKMQTSNVLILGLKGLGVEIAKNVVLAGVKSMTVFDPEPVQLADLSTQFFLTEKDIGQKRGDVTRAKLAELNAYVPVNVLDSLDDVTQLSQFQVVVATDTVSLEDKVKINEFCHSSGIRFISSETRGLFGNTFVDLGDEFTVLDPTGEEPRTGMVSDIEPDGTVTMLDDNRHGLEDGNFVRFSEVEGLDKLNDGTLFKVEVLGPFAFRIGSVKEYGEYKKGGIFTEVKVPRKISFKSLKQQLSNPEFVFSDFAKFDRAAQLHLGFQALHQFAVRHNGELPRTMNDEDANELIKLVTDLSVQQPEVLGEGVDVNEDLIKELSYQARGDIPGVVAFFGGLVAQEVLKACSGKFTPLKQFMYFDSLESLPDPKNFPRNEKTTQPVNSRYDNQIAVFGLDFQKKIANSKVFLVGSGAIGCEMLKNWALLGLGSGSDGYIVVTDNDSIEKSNLNRQFLFRPKDVGKNKSEVAAEAVCAMNPDLKGKINAKIDKVGPETEEIFNDSFWESLDFVTNALDNVDARTYVDRRCVFYRKPLLESGTLGTKGNTQVIIPRLTESYSSSRDPPEKSIPLCTLRSFPNKIDHTIAWAKSLFQGYFTDSAENVNMYLTQPNFVEQTLKQSGDVKGVLESISDSLSSKPHNFEDCIKWARLEFEKKFNHDIKQLLFNFPKDAKTSNGEPFWSGAKRAPTPLEFDIYNNDHFHFVVAGASLRAYNYGIKSDDSNSKPNVDEYKSVIDHMIIPEFTPNANLKIQVNDDDPDPNANAANGSDEIDQLVSSLPDPSTLAGFKLEPVDFEKDDDTNHHIEFITACSNCRAQNYFIETADRQKTKFIAGRIIPAIATTTSLVTGLVNLELYKLIDNKTDIEQYKNGFVNLALPFFGFSEPIASPKGEYNNKKYDKIWDRFDIKGDIKLSDLIEHFEKDEGLEITMLSYGVSLLYASFFPPKKLKERLNLPITQLVKLVTKKDIPAHVSTMILEICADDKEGEDVEVPFITIHL

SEQ ID NO: 1514 - protein, 2233 aa, Saccharomyces cerevisiae
  source: /note="strain ATCC 204508 / S288c"
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 1515 - protein, 77 aa, Saccharomyces cerevisiae; identical to SEQ ID NO: 645
  source: /note="strain ATCC 204508 / S288c"

SEQ ID NO: 1516 - protein, 79 aa, Saccharomyces cerevisiae; identical to SEQ ID NO: 552
  source: /note="strain ATCC 204508 / S288c"

SEQ ID NO: 1517 - protein, 86 aa, Saccharomyces cerevisiae; identical to SEQ ID NO: 591
  source: /note="strain ATCC 204508 / S288c"

SEQ ID NO: 1518 - protein, 93 aa, Saccharomyces cerevisiae; identical to SEQ ID NO: 589
  source: /note="strain ATCC 204508 / S288c"

SEQ ID NO: 1519 - protein, 100 aa, Saccharomyces cerevisiae; identical to SEQ ID NO: 616
  source: /note="strain ATCC 204508 / S288c"

SEQ ID NO: 1520 - protein, 98 aa, Saccharomyces cerevisiae
  source: /note="strain ATCC 204508 / S288c"
MKSSIPITEVLPRAVGSLTFDENYNLLDTSGVAKVIEKSPIAEIIRKSNAELGRLGYSVYEDAQYIGHAFKKAGHFIVYFTPKNKNREGVVPPVGITN

SEQ ID NO: 1521 - protein, 106 aa, Saccharomyces cerevisiae; identical to SEQ ID NO: 587
  source: /note="strain ATCC 204508 / S288c"

SEQ ID NO: 1522 - protein, 107 aa, Saccharomyces cerevisiae; identical to SEQ ID NO: 635
  source: /note="strain ATCC 204508 / S288c"

SEQ ID NO: 1523 - protein, 119 aa, Saccharomyces cerevisiae; identical to SEQ ID NO: 629
  source: /note="strain ATCC 204508 / S288c"

SEQ ID NO: 1524 - protein, 113 aa, Saccharomyces cerevisiae; identical to SEQ ID NO: 537
  source: /note="strain ATCC 204508 / S288c"

SEQ ID NO: 1525 - protein, 132 aa, Saccharomyces cerevisiae
  source: /note="strain ATCC 204508 / S288c"
MSGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKTAKASQEL

SEQ ID NO: 1526 - protein, 137 aa, Saccharomyces cerevisiae
  source: /note="strain ATCC 204508 / S288c"
MSGNGAQGTKFRISLGLPVGAIMNCADNSGARNLYIIAVKGSGSRLNRLPAASLGDMVMATVKKGKPELRKKVMPAIVVRQAKSWRRRDGVFLYFEDNAGVIANPKGEMKGSAITGPVGKECADLWPRVASNSGVVV

SEQ ID NO: 1527 - protein, 126 aa, Saccharomyces cerevisiae
  source: /note="strain ATCC 204508 / S288c"
MSWQAYTDNLIGTGKVDKAVIYSRAGDAVWATSGGLSLQPNEIGEIVQGFDNPAGLQSNGLHIQGQKFMLLRADDRSIYGRHDAEGVVCVRTKQTVIIAHYPPTVQAGEATKIVEQLADYLIGVQY

SEQ ID NO: 1528 - protein, 139 aa, Saccharomyces cerevisiae
  source: /note="strain ATCC 204508 / S288c"
MWKAVMNAWNGTESQSKNVSNIQSYSFEDMKRIVGKHDPNVVLVDVREPSEYSIVHIPASINVPYRSHPDAFALDPLEFEKQIGIPKPDSAKELIFYCASGKRGGEAQKVASSHGYSNTSLYPGSMNDWVSHGGDKLDL

SEQ ID NO: 1529 - protein, 145 aa, Saccharomyces cerevisiae; identical to SEQ ID NO: 570
  source: /note="strain ATCC 204508 / S288c"

SEQ ID NO: 1530 - protein, 174 aa, Saccharomyces cerevisiae
  source: /note="strain ATCC 204508 / S288c"
MSAIPENANVTVLNKNEKKARELIGKLGLKQIPGIIRVTFRKKDNQIYAIEKPEVFRSAGGNYVVFGEAKVDNFTQKLAAAQQQAQASGIMPSNEDVATKSPEDIQADMQAAAEGSVNAAAEEDDEEGEVDAGDLNKDDIELVVQQTNVSKNQAIKALKAHNGDLVNAIMSLSK

SEQ ID NO: 1531 - protein, 181 aa, Saccharomyces cerevisiae
  source: /note="strain ATCC 204508 / S288c"
MGLFASKLFSNLFGNKEMRILMVGLDGAGKTTVLYKLKLGEVITTIPTIGFNVETVQYKNISFTVWDVGGQDRIRSLWRHYYRNTEGVIFVVDSNDRSRIGEAREVMQRMLNEDELRNAAWLVFANKQDLPEAMSAAEITEKLGLHSIRNRPWFIQATCATSGEGLYEGLEWLSNSLKNST

SEQ ID NO: 1532 - protein, 187 aa, Saccharomyces cerevisiae; identical to SEQ ID NO: 497
  source: /note="strain ATCC 204508 / S288c"

SEQ ID NO: 1533 - protein, 198 aa, Saccharomyces cerevisiae
  source: /note="strain ATCC 204508 / S288c"
MDIILGIRVQDSVILASSKAVTRGISVLKDSDDKTRQLSPHTLMSFAGEAGDTVQFAEYIQANIQLYSIREDYELSPQAVSSFVRQELAKSIRSRRPYQVNVLIGGYDKKKNKPELYQIDYLGTKVELPYGAHGYSGFYTFSLLDHHYRPDMTTEEGLDLLKLCVQELEKRMPMDFKGVIVKIVDKDGIRQVDDFQAQ

SEQ ID NO: 1534 - protein, 213 aa, Saccharomyces cerevisiae; identical to SEQ ID NO: 489
  source: /note="strain ATCC 204508 / S288c"

SEQ ID NO: 1535 - protein, 227 aa, Saccharomyces cerevisiae
  source: /note="strain ATCC 204508 / S288c"
MSPMKVAVVGASGKVGRLLINQLKANDSFSTPLAIVRTQDQVNYFKNEVGVDASLTDIENASVSEITDAIKAYDAVVFSAGAGGKGMERIFTVDLDGCIKVVEACEKAGIKRFVVVSALKAEDRDFWYNIKGLREYYIAKRSADREVRNSNLDYTILQPGSLELNKGTGLLQPLDKLEEKASVNYSINREDVASFIVESLLHPNATVKKTISLVNGNEPMEKFIQSL

SEQ ID NO: 1536 - protein, 231 aa, Saccharomyces cerevisiae
  source: /note="strain ATCC 204508 / S288c"
MFLRNVRVISLNSRRLFRTMSTVKGKPEDAKIIEARHVKETSDCKWIGLQKIIYKDPNGKEREWDSAVRTTRSSGGVDGIGILTILKYKDGKPDEILLQKQFRPPVEGVCIEMPAGLIDAGEDIDTAALRELKEETGYSGKIISKSPTVFNDPGFTNTNLCLVTVEVDMSLPENQKPVTQLEDNEFIECFSVELHKFPDEMVKLDQQGYKLDARVQNVAQGILMAKQYHIK

SEQ ID NO: 1537 - protein, 245 aa, Saccharomyces cerevisiae
  source: /note="strain ATCC 204508 / S288c"
MATRTQFENSNEIGVFSKLTNTYCLVAVGGSENFYSAFEAELGDAIPIVHTTIAGTRIIGRMTAGNRRGLLVPTQTTDQELQHLRNSLPDSVKIQRVEERLSALGNVICCNDYVALVHPDIDRETEELISDVLGVEVFRQTISGNILVGSYCSLSNQGGLVHPQTSVQDQEELSSLLQVPLVAGTVNRGSSVVGAGMVVNDYLAVTGLDTTAPELSVIESIFRLQDAQPESISGNLRDTLIETYS

SEQ ID NO: 1538 - protein, 234 aa, Saccharomyces cerevisiae
  source: /note="strain ATCC 204508 / S288c"
MSLPIIKVHWLDHSRAFRLLWLLDHLNLEYEIVPYKRDANFRAPPELKKIHPLGRSPLLEVQDRETGKKKILAESGFIFQYVLQHFDHSHVLMSEDADIADQINYYLFYVEGSLQPPLMIEFILSKVKDSGMPFPISYLARKVADKISQAYSSGEVKNQFDFVEGEISKNNGYLVDGKLSGADILMSFPLQMAFERKFAAPEDYPAISKWLKTITSEESYAASKEKARALGSNF

SEQ ID NO: 1539 - protein, 240 aa, Saccharomyces cerevisiae; identical to SEQ ID NO: 482
  source: /note="strain ATCC 204508 / S288c"

SEQ ID NO: 1540 - protein, 234 aa, Saccharomyces cerevisiae
  source: /note="strain ATCC 204508 / S288c"
MRFLRGFVFSLAFTLYKVTATAEIGSEINVENEAPPDGLSWEEWHMDHEHQLKDYTPETFFALHDIKKKGFLDENDILSLYGLNREEIVGAGDGMGQHDESEKIDNEMAKRVVSLIMRLLDVDDNTKITKEEYLQFAKRGNKFPDLGVGVGHHSDFELEYEIHHWNKFHKDKDPDVKVVHKEDIEHELLHHEHEIEHEEEIQRGASRATVITDDELESRIELKNIPEKFKNGIF

SEQ ID NO: 1541 - protein, 251 aa, Saccharomyces cerevisiae
  source: /note="strain ATCC 204508 / S288c"
MLDLLRLQLTTFIMNDVPTPYACYFQDSATPNQEGILELHDNIMFYLLVILGLVSWMLYTIVMTYSKNPIAYKYIKHGQTIEVIWTIFPAVILLIIAFPSFILLYLCDEVISPAMTIKAIGYQWYWKYEYSDFINDSGETVEFESYVIPDELLEEGQLRLLDTDTSMVVPVDTHIRFVVTAADVIHDFAIPSLGIKVDATPGRLNQVSALIQREGVFYGACSELCGTGHANMPIKIEAVSLPKFLEWLNEQ

SEQ ID NO: 1542 - protein, 258 aa, Saccharomyces cerevisiae
  source: /note="strain ATCC 204508 / S288c"
MLEAKFEEASLFKRIIDGFKDCVQLVNFQCKEDGIIAQAVDDSRVLLVSLEIGVEAFQEYRCDHPVTLGMDLTSLSKILRCGNNTDTLTLIADNTPDSIILLFEDTKKDRIAEYSLKLMDIDADFLKIEELQYDSTLSLPSSEFSKIVRDLSQLSDSINIMITKETIKFVADGDIGSGSVIIKPFVDMEHPETSIKLEMDQPVDLTFGAKYLLDIIKGSSLSDRVGIRLSSEAPALFQFDLKSGFLQFFLAPKFNDEE

SEQ ID NO: 1543 - protein, 260 aa, Saccharomyces cerevisiae
  source: /note="strain ATCC 204508 / S288c"
MFLTRSEYDRGVSTFSPEGRLFQVEYSLEAIKLGSTAIGIATKEGVVLGVEKRATSPLLESDSIEKIVEIDRHIGCAMSGLTADARSMIEHARTAAVTHNLYYDEDINVESLTQSVCDLALRFGEGASGEERLMSRPFGVALLIAGHDADDGYQLFHAEPSGTFYRYNAKAIGSGSEGAQAELLNEWHSSLTLKEAELLVLKILKQVMEEKLDENNAQLSCITKQDGFKIYDNEKTAELIKELKEKEAAESPEEADVEMS

SEQ ID NO: 1544 - protein, 266 aa, Saccharomyces cerevisiae
  source: /note="strain ATCC 204508 / S288c"
MLNVLLRRKAFCLVTKKGMATATTAAATHTPRLKTFKVYRWNPDEPSAKPHLQSYQVDLNDCGPMVLDALLKIKDEQDSTLTFRRSCREGICGSCAMNIGGRNTLACICKIDQNESKQLKIYPLPHMFIVKDLVPDLTNFYQQYKSIQPYLQRSSFPKDGTEVLQSIEDRKKLDGLYECILCACCSTSCPSYWWNQEQYLGPAVLMQAYRWLIDSRDQATKTRKAMLNNSMSLYRCHTIMNCTRTCPKGLNPGLAIAEIKKSLAFA

SEQ ID NO: 1545 - protein, 287 aa, Saccharomyces cerevisiae
  source: /note="strain ATCC 204508 / S288c"
MQAIADSFSVPNRLVKELQYDNEQNLESDFVTGASQFQRLAPSLTVPPIASPQQFLRAHTDDSRNPDCKIKIAHGTTTLAFRFQGGIIVAVDSRATAGNWVASQTVKKVIEINPFLLGTMAGGAADCQFWETWLGSQCRLHELREKERISVAAASKILSNLVYQYKGAGLSMGTMICGYTRKEGPTIYYVDSDGTRLKGDIFCVGSGQTFAYGVLDSNYKWDLSVEDALYLGKRSILAAAHRDAYSGGSVNLYHVTEDGWIYHGNHDVGELFWKVKEEEGSFNNVIG

SEQ ID NO: 1546 - protein, 297 aa, Saccharomyces cerevisiae; identical to SEQ ID NO: 603
  source: /note="strain ATCC 204508 / S288c"

SEQ ID NO: 1547 - protein, 309 aa, Saccharomyces cerevisiae
  source: /note="strain ATCC 204508 / S288c"
MFSNLSKRWAQRTLSKSFYSTATGAASKSGKLTQKLVTAGVAAAGITASTLLYADSLTAEAMTAAEHGLHAPAYAWSHNGPFETFDHASIRRGYQVYREVCAACHSLDRVAWRTLVGVSHTNEEVRNMAEEFEYDDEPDEQGNPKKRPGKLSDYIPGPYPNEQAARAANQGALPPDLSLIVKARHGGCDYIFSLLTGYPDEPPAGVALPPGSNYNPYFPGGSIAMARVLFDDMVEYEDGTPATTSQMAKDVTTFLNWCAEPEHDERKRLGLKTVIILSSLYLLSIWVKKFKWAGIKTRKFVFNPPKPRK

SEQ ID NO: 1548 - protein, 304 aa, Saccharomyces cerevisiae
  source: /note="strain ATCC 204508 / S288c"
MVTQQEKEFLESYPQNCPPDALPGTPGNLDSAQEKALAELRKLLEDAGFIERLDDSTLLRFLRARKFDVQLAKEMFENCEKWRKDYGTDTILQDFHYDEKPLIAKFYPQYYHKTDKDGRPVYFEELGAVNLHEMNKVTSEERMLKNLVWEYESVVQYRLPACSRAAGHLVETSCTIMDLKGISISSAYSVMSYVREASYISQNYYPERMGKFYIINAPFGFSTAFRLFKPFLDPVTVSKIFILGSSYQKELLKQIPAENLPVKFGGKSEVDESKGGLYLSDIGPWRDPKYIGPEGEAPEAFSMK

SEQ ID NO: 1549 - protein, 322 aa, Saccharomyces cerevisiae
  source: /note="strain ATCC 204508 / S288c"
MPLNKSNIREYKLVVVGGGGVGKSALTIQLTQSHFVDEYDPTIEDSYRKQVVIDDEVSILDILDTAGQEEYSAMREQYMRNGEGFLLVYSITSKSSLDELMTYYQQILRVKDTDYVPIVVVGNKSDLENEKQVSYQDGLNMAKQMNAPFLETSAKQAINVEEAFYTLARLVRDEGGKYNKTLTENDNSKQTSQDTKGSGANSVPRNSGGHRKMSNAANGKNVNSSTTVVNARNASIESKTGLAGNQATNGKTQTDRTNIDNSTGQAGQANAQSANTVNNRVNNNSKAGQVSNAKQARKQQAAPGGNTSEASKSGSGGCCIIS

SEQ ID NO: 1550 - protein, 312 aa, Saccharomyces cerevisiae
  source: /note="strain ATCC 204508 / S288c"
MPATLHDSTKILSLNTGAQIPQIGLGTWQSKENDAYKAVLTALKDGYRHIDTAAIYRNEDQVGQAIKDSGVPREEIFVTTKLWCTQHHEPEVALDQSLKRLGLDYVDLYLMHWPARLDPAYIKNEDILSVPTKKDGSRAVDITNWNFIKTWELMQELPKTGKTKAVGVSNFSINNLKDLLASQGNKLTPAANQVEIHPLLPQDELINFCKSKGIVVEAYSPLGSTDAPLLKEPVILEIAKKNNVQPGHVVISWHVQRGYVVLPKSVNPDRIKTNRKIFTLSTEDFEAINNISKEKGEKRVVHPNWSPFEVFK

SEQ ID NO: 1551 - protein, 329 aa, Saccharomyces cerevisiae
  source: /note="strain ATCC 204508 / S288c"
MLRSTVSKASLKICRHFHRESIPYDKTIKNLLLPKDTKVIFQGFTGKQGTFHASISQEYGTNVVGGTNPKKAGQTHLGQPVFASVKDAIKETGATASAIFVPPPIAAAAIKESIEAEIPLAVCITEGIPQHDMLYIAEMLQTQDKTRLVGPNCPGIINPATKVRIGIQPPKIFQAGKIGIISRSGTLTYEAVQQTTKTDLGQSLVIGMGGDAFPGTDFIDALKLFLEDETTEGIIMLGEIGGKAEIEAAQFLKEYNFSRSKPMPVASFIAGTVAGQMKGVRMGHSGAIVEGSGTDAESKKQALRDVGVAVVESPGYLGQALLDQFAKFK

SEQ ID NO: 1552 - protein, 325 aa, Saccharomyces cerevisiae
  source: /note="strain ATCC 204508 / S288c"
MSTNFEKHFQENVDECTLEQLRDILVNKSGKTVLANRFRALFNLKTVAEEFATKPEEAKKAIEYIAESFVNDKSELLKHEVAYVLGQTKNLDAAPTLRHVMLDQNQEPMVRHEAAEALGALGDKDSLDDLNKAAKEDPHVAVRETCELAINRINWTHGGAKDKENLQQSLYSSIDPAPPLPLEKDATIPELQALLNDPKQPLFQRYRAMFRLRDIGTDEAILALATGFSAESSLFKHEIAYVFGQIGSPAAVPSLIEVLGRKEEAPMVRHEAAEALGAIASPEVVDVLKSYLNDEVDVVRESCIVALDMYDYENSNELEYAPTAN

SEQ ID NO: 1553 - protein, 342 aa, Saccharomyces cerevisiae
  source: /note="strain ATCC 204508 / S288c"
MSVFVSGANGFIAQHIVDLLLKEDYKVIGSARSQEKAENLTEAFGNNPKFSMEVVPDISKLDAFDHVFQKHGKDIKIVLHTASPFCFDITDSERDLLIPAVNGVKGILHSIKKYAADSVERVVLTSSYAAVFDMAKENDKSLTFNEESWNPATWESCQSDPVNAYCGSKKFAEKAAWEFLEENRDSVKFELTAVNPVYVFGPQMFDKDVKKHLNTSCELVNSLMHLSPEDKIPELFGGYIDVRDVAKAHLVAFQKRETIGQRLIVSEARFTMQDVLDILNEDFPVLKGNIPVGKPGSGATHNTLGATLDNKKSKKLLGFKFRNLKETIDDTASQILKFEGRI

SEQ ID NO: 1554 - protein, 344 aa, Saccharomyces cerevisiae
  source: /note="strain ATCC 204508 / S288c"
MSSSVASTENIVENMLHPKTTEIYFSLNNGVRIPALGLGTANPHEKLAETKQAVKAAIKAGYRHIDTAWAYETEPFVGEAIKELLEDGSIKREDLFITTKVWPVLWDEVDRSLNESLKALGLEYVDLLLQHWPLCFEKIKDPKGISGLVKTPVDDSGKTMYAADGDYLETYKQLEKIYLDPNDHRVRAIGVSNFSIEYLERLIKECRVKPTVNQVETHPHLPQMELRKFCFMHDILLTAYSPLGSHGAPNLKIPLVKKLAEKYNVTGNDLLISYHIRQGTIVIPRSLNPVRISSSIEFASLTKDELQELNDFGEKYPVRFIDEPFAAILPEFTGNGPNLDNLKY

SEQ ID NO: 1555 - protein, 350 aa, Saccharomyces cerevisiae
  source: /note="strain ATCC 204508 / S288c"
MSKKPIVLKLGKDAFGDQAWGELEKIADVITIPESTTREQFLREVKDPQNKLSQVQVITRTARSVKNTGRFDEELALALPSSVVAVCHTGAGYDQIDVEPFKKRHIQVANVPDLVSNATADTHVFLLLGALRNFGIGNRRLIEGNWPEAGPACGSPFGYDPEGKTVGILGLGRIGRCILERLKPFGFENFIYHNRHQLPSEEEHGCEYVGFEEFLKRSDIVSVNVPLNHNTHHLINAETIEKMKDGVVIVNTARGAVIDEQAMTDALRSGKIRSAGLDVFEYEPKISKELLSMSQVLGLPHMGTHSVETRKKMEELVVENAKNVILTGKVLTIVPELQNEDWPNESKPLV

SEQ ID NO: 1556 - protein, 345 aa, Saccharomyces cerevisiae
  source: /note="strain ATCC 204508 / S288c"
MEGVYFNIDNGFIEGVVRGYRNGLLSNNQYINLTQCDTLEDLKLQLSSTDYGNFLSSVSSESLTTSLIQEYASSKLYHEFNYIRDQSSGSTRKFMDYITYGYMIDNVALMITGTIHDRDKGEILQRCHPLGWFDTLPTLSVATDLESLYETVLVDTPLAPYFKNCFDTAEELDDMNIEIIRNKLYKAYLEDFYNFVTEEIPEPAKECMQTLLGFEADRRSINIALNSLQSSDIDPDLKSDLLPNIGKLYPLATFHLAQAQDFEGVRAALANVYEYRGFLETGNLEDHFYQLEMELCRDAFTQQFAISTVWAWMKSKEQEVRNITWIAECIAQNQRERINNYISVY

SEQ ID NO: 1557 - protein, 365 aa, Saccharomyces cerevisiae
  source: /note="strain ATCC 204508 / S288c"
MVLAKQWVLKNLPTPGEPFNFHFHDPACTFELIEKELSSEQLKDGELLLETTYLSNDPAQKFWISSMDKNYAKGVQPGEIIPARGIGKVLASRNKAFSPGDYVSAVTGWTTHAIISQENVQGLRKLDKNKVGKLWWYLSVLGGTSLTAYFIFFTYAQLQEREEDYGKVYLISGAAGAVGTVCIQLALNVFKASKVIAIAGGPEKVAFVESFGDNVVGVDYKDPSFKQKLIEAAGGENTVDYFIDNVGSNVLEAGVLLLKQRAMLIACGAISAYNDPSKFVFKGYSFILTKRLVVKGVLVTDNIDDFPKALDKLGSLVKHGKIDLLKSATLEDGTGDKFKNVPLIWKGLFSGVNKGKLITKVNNEE

SEQ ID NO: 1558 - protein, 350 aa, Saccharomyces cerevisiae [sequence omitted]

SEQ ID NO: 1559 - protein, 398 aa, Saccharomyces cerevisiae
  source: /note="strain ATCC 204508 / S288c"
MVSLTFKNFKKEKVPLDLEPSNTILETKTKLAQSISCEESQIKLIYSGKVLQDSKTVSECGLKDGDQVVFMVSQKKSTKTKVTEPPIAPESATTPGRENSTEASPSTDASAAPAATAPEGSQPQEEQTATTERTESASTPGFVVGTERNETIERIMEMGYQREEVERALRAAFNNPDRAVEYLLMGIPENLRQPEPQQQTAAAAEQPSTAATTAEQPAEDDLFAQAAQGGNASSGALGTTGGATDAAQGGPPGSIGLTVEDLLSLRQVVSGNPEALAPLLENISARYPQLREHIMANPEVFVSMLLEAVGDNMQDVMEGADDMVEGEDIEVTGEAAAAGLGQGEGEGSFQVDYTPEDDQAISRLCELGFERDLVIQVYFACDKNEEAAANILFSDHAD

SEQ ID NO: 1560 - protein, 387 aa, Saccharomyces cerevisiae
  source: /note="strain ATCC 204508 / S288c"
MSAPTPLAEASQIPTIPALSPLTAKQSKGNFFSSNPISSFVVDTYKQLHSHRQSLELVNPGTVENLNKEVSRDVFLSQYFFTGLRADLNKAFSMNPAFQTSHTFSIGSQALPKYAFSALFANDNLFAQGNIDNDLSVSGRLNYGWDKKNISKVNLQISDGQPTMCQLEQDYQASDFSVNVKTLNPSFSEKGEFTGVAVASFLQSVTPQLALGLETLYSRTDGSAPGDAGVSYLTRYVSKKQDWIFSGQLQANGALIASLWRKVAQNVEAGIETTLQAGMVPITDPLMGTPIGIQPTVEGSTTIGAKYEYRQSVYRGTLDSNGKVACFLERKVLPTLSVLFCGEIDHFKNDTKIGCGLQFETAGNQELLMLQQGLDADGNPLQALPQL

SEQ ID NO: 1561 - protein, 396 aa, Saccharomyces cerevisiae
  source: /note="strain ATCC 204508 / S288c"
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSLFGGYVAWEMGKAEDGHDSMAVQIADSSDWPQMKACVLVVSDIKKDVSSTQGMQLTVATSELFKERIEHVVPKRFEVMRKAIVEKDFATFAKETMMDSNSFHATCLDSFPPIFYMNDTSKRIISWCHTINQFYGETIVAYTFDAGPNAVLYYLAENESKLFAFIYKLFGSVPGWDKKFTTEQLEAFNHQFESSNFTARELDLELQKDVARVILTQVGSGPQETNESLIDAKTGLPKE

SEQ ID NO: 1562 - protein, 414 aa, Saccharomyces cerevisiae
  source: /note="strain ATCC 204508 / S288c"
MAKTTKVKGNKKEVKASKQAKEEKAKAVSSSSSESSSSSSSSSESESESESESESSSSSSSSDSESSSSSSSDSESEAETKKEESKDSSSSSSDSSSDEEEEEEKEETKKEESKESSSSDSSSSSSSDSESEKEESNDKKRKSEDAEEEEDEESSNKKQKNEETEEPATIFVGRLSWSIDDEWLKKEFEHIGGVIGARVIYERGTDRSRGYGYVDFENKSYAEKAIQEMQGKEIDGRPINCDMSTSKPAGNNDRAKKFGDTPSEPSDTLFLGNLSFNADRDAIFELFAKHGEVVSVRIPTHPETEQPKGFGYVQFSNMEDAKKALDALQGEYIDNRPVRLDFSSPRPNNDGGRGGSRGFGGRGGGRGGNRGFGGRGGARGGRGGFRPSGSGANTAPLGRSRNTASFAGSKKTFD

SEQ ID NO: 1563 - protein, 403 aa, Saccharomyces cerevisiae
  source: /note="strain ATCC 204508 / S288c"
MLRNLVVRNACRNRPSIQVARGLCRHQTRRLMASSPQFGRNSNQEKTAGFIMGILSMAGALYFIAPNRKPLFASRKVESDKTAEEELSSGGEQSPENEDDNNSKSDENGDDNDSKNDETEAGPQLGGDKIGASKVAEDGELVVLAEEDNKSSEDKDTDESKVSTKDDEQSNEDNATANNQKDENISSENSEENTSDKTLDNNAGSSEKKDPEHSDDEKSQQGQSDDKTTTEDNNGEEESSKKTVSDSENSAKQSESSDEEKEELRKQEEKQMGPTEEEVQHEGAYNPDTGEINWDCPCLGGMAHGPCGEEFKSAFSCFVYSEAEPKGIDCVEKFQHMQDCFRKYPEHYAEQLKETSDDEEPQDKVKVNTIESAPNVSSAKENAAKKAEQSDVKKEPLNEESKP

SEQ ID NO: 1564 - protein, 418 aa, Saccharomyces cerevisiae
  source: /note="strain ATCC 204508 / S288c"
MSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 1565 - protein, 411 aa, Saccharomyces cerevisiae
  source: /note="strain ATCC 204508 / S288c"
MEEKEGIKDSSLLEKSNVPESINEDISKTTDVDLNSDGKKDNDTSAKDGTPKVEEKVNKSSGIDEDEVVTPAEDAKEEEEEHPPLPARRKSEEEPSKENPILQELKDAFPNLEEKYIKAVIIASQGVLSPAFNALLFLSDPESGKDIELPTQPVRKNPEAPARRRQTQLEQDELLARQLDEQFNSSHSRRRNRDRATRSMHEQRRRRHNPNEREQHHEDSEEEDSWSQFVEKDLPELTDRAGRSLQDTANKVSNWISDAYRRNFASGNEQNDNQHGHQDQQEWEPEIVDLSQGGKNSRPQQPERRRFNSFGVQVGDDSLESHGITLHNEDGFEDDEDVPPQLPTRTKSGESTGKVVAETTYIDTPDTETKKKWQPLPPEPLDTTPTKVNAVSRNKKNPDEDEFLINSDDEM

SEQ ID NO: 1566 - protein, 437 aa, Saccharomyces cerevisiae
  source: /note="strain ATCC 204508 / S288c"
MSEEQDPLLAGLGETSGDNHTQQSHEQQPEQPQETEEHHEEEPSRVDPEQEAHNKALNQFKRKLLEHRRYDDQLKQRRQNIRDLEKLYDKTENDIKALQSIGQLIGEVMKELSEEKYIVKASSGPRYIVGVRNSVDRSKLKKGVRVTLDITTLTIMRILPRETDPLVYNMTSFEQGEITFDGIGGLTEQIRELREVIELPLKNPEIFQRVGIKPPKGVLLYGPPGTGKTLLAKAVAATIGANFIFSPASGIVDKYIGESARIIREMFAYAKEHEPCIIFMDEVDAIGGRRFSEGTSADREIQRTLMELLTQMDGFDNLGQTKIIMATNRPDTLDPALLRPGRLDRKVEIPLPNEAGRLEIFKIHTAKVKKTGEFDFEAAVKMSDGFNGADIRNCATEAGFFAIRDDRDHINPDDLMKAVRKVAEVKKLEGTIEYQKL

SEQ ID NO: 1567 - protein, 463 aa, Saccharomyces cerevisiae; identical to SEQ ID NO: 752
  source: /note="strain ATCC 204508 / S288c"

SEQ ID NO: 1568 - protein, 457 aa, Saccharomyces cerevisiae
  source: /note="strain ATCC 204508 / S288c"
MREIIHISTGQCGNQIGAAFWETICGEHGLDFNGTYHGHDDIQKERLNVYFNEASSGKWVPRSINVDLEPGTIDAVRNSAIGNLFRPDNYIFGQSSAGNVWAKGHYTEGAELVDSVMDVIRREAEGCDSLQGFQITHSLGGGTGSGMGTLLISKIREEFPDRMMATFSVLPSPKTSDTVVEPYNATLSVHQLVEHSDETFCIDNEALYDICQRTLKLNQPSYGDLNNLVSSVMSGVTTSLRYPGQLNSDLRKLAVNLVPFPRLHFFMVGYAPLTAIGSQSFRSLTVPELTQQMFDAKNMMAAADPRNGRYLTVAAFFRGKVSVKEVEDEMHKVQSKNSDYFVEWIPNNVQTAVCSVAPQGLDMAATFIANSTSIQELFKRVGDQFSAMFKRKAFLHWYTSEGMDELEFSEAESNMNDLVSEYQQYQEATVEDDEEVDENGDFGAPQNQDEPITENFE

SEQ ID NO: 1569 - protein, 463 aa, Saccharomyces cerevisiae; identical to SEQ ID NO: 811
  source: /note="strain ATCC 204508 / S288c"

SEQ ID NO: 1570 - protein, 462 aa, Saccharomyces cerevisiae
  source: /note="strain ATCC 204508 / S288c"
MLDINQFIEDKGGNPELIRQSQKARNASVEIVDEIISDYKDWVKTRFELDELNKKFNKLQKDIGLKFKNKEDASGLLAEKEKLTQQKKELTEKEQQEDKDLKKKVFQVGNIVHPSVVVSNDEENNELVRTWKPEDLEAVGPIASVTGKPASLSHHEILLRLDGYDPDRGVKICGHRGYFFRNYGVFLNQALINYGLQFLAAKGYIPLQAPVMMNKELMSKTAQLSEFDEELYKVIDGEDEKYLIATSEQPISAYHSGEWFEKPQEQLPIHYVGYSSCFRREAGSHGKDAWGVFRVHAFEKIEQFVITEPEKSWEEFEKMISYSEEFYKSLKLPYRIVGIVSGELNNAAAKKYDLEAWFPYQKEYKELVSCSNCTDYQSRNLEIRCGIKKMGDREKKYVHCLNSTLAATQRALCCILENYQTEDGLVVPEVLRKYIPGEPEFLPFVNELPKNSTSSKDKKKKN

SEQ ID NO: 1571 - protein, 471 aa, Saccharomyces cerevisiae
  source: /note="strain ATCC 204508 / S288c"
MSICEQYYPEEPTKPTVKTESIPGPESQKQLKELGEVFDTRPAYFLADYEKSLGNYITDVDGNTYLDLYAQISSIALGYNNPALIKAAQSPEMIRALVDRPALGNFPSKDLDKILKQILKSAPKGQDHVWSGLSGADANELAFKAAFIYYRAKQRGYDADFSEKENLSVMDNDAPGAPHLAVLSFKRAFHGRLFASGSTTCSKPIHKLDFPAFHWPHAEYPSYQYPLDENSDANRKEDDHCLAIVEELIKTWSIPVAALIIEPIQSEGGDNHASKYFLQKLRDITLKYNVVYIIDEVQTGVGATGKLWCHEYADIQPPVDLVTFSKKFQSAGYFFHDPKFIPNKPYRQFNTWCGEPARMIIAGAIGQEISDKKLTEQCSRVGDYLFKKLEGLQKKYPENFQNLRGKGRGTFIAWDLPTGEKRDLLLKKLKLNGCNVGGCAVHAVRLRPSLTFEEKHADIFIEALAKSVNEL

SEQ ID NO: 1572 - protein, 488 aa, Saccharomyces cerevisiae
  source: /note="strain ATCC 204508 / S288c"
MLRFTNCSCKTFVKSSYKLNIRRMNSSFRTETDAFGEIHVPADKYWGAQTQRSFQNFKIGGARERMPLPLVHAFGVLKKSAAIVNESLGGLDPKISKAIQQAADEVASGKLDDHFPLVVFQTGSGTQSNMNANEVISNRAIEILGGKIGSKQVHPNNHCNQSQSSNDTFPTVMHIAASLQIQNELIPELTNLKNALEAKSKEFDHIVKIGRTHLQDATPLTLGQEFSGYVQQVENGIQRVAHSLKTLSFLAQGGTAVGTGLNTKPGFDVKIAEQISKETGLKFQTAPNKFEALAAHDAIVECSGALNTLACSLFKIAQDIRYLGSGPRCGYHELMLPENEPGSSIMPGKVNPTQNEALTQVCVQVMGNNAAITFAGSQGQFELNVFKPVMIANLLNSIRLITDAAYSFRVHCVEGIKANEPRIHELLTKSLMLVTALNPKIGYDAASKVAKNAHKKGITLKESALELGVLTEKEFDEWVVPEHMLGPK

SEQ ID NO: 1573 - protein, 514 aa, Saccharomyces cerevisiae
  source: /note="strain ATCC 204508 / S288c"
MPNASQVYRSTRSSSPKTISFEEAIIQGLATDGGLFIPPTIPQVDQATLFNDWSKLSFQDLAFAIMRLYIAQEEIPDADLKDLIKRSYSTFRSDEVTPLVQNVTGDKENLHILELFHGPTYAFKDVALQFVGNLFEYFLQRTNANLPEGEKKQITVVGATSGDTGSAAIYGLRGKKDVSVFILYPTGRISPIQEEQMTTVPDENVQTLSVTGTFDNCQDIVKAIFGDKEFNSKHNVGAVNSINWARILAQMTYYFYSFFQATNGKDSKKVKFVVPSGNFGDILAGYFAKKMGLPIEKLAIATNENDILDRFLKSGLYERSDKVAATLSPAMDILISSNFERLLWYLAREYLANGDDLKAGEIVNNWFQELKTNGKFQVDKSIIEGASKDFTSERVSNEETSETIKKIYESSVNPKHYILDPHTAVGVCATERLIAKDNDKSIQYISLSTAHPAKFADAVNNALSGFSNYSFEKDVLPEELKKLSTLKKKLKFIERADVELVKNAIEEELAKMKL

SEQ ID NO: 1574 - protein, 514 aa, Saccharomyces cerevisiae
  source: /note="strain ATCC 204508 / S288c"
MEEQREILEQLKKTLQMLTVEPSKNNQIANEEKEKKENENSWCILEHNYEDIAQEFIDFIYKNPTTYHVVSFFAELLDKHNFKYLSEKSNWQDSIGEDGGKFYTIRNGTNLSAFILGKNWRAEKGVGVIGSHVDALTVKLKPVSFKDTAEGYGRIAVAPYGGTLNELWLDRDLGIGGRLLYKKKGTNEIKSALVDSTPLPVCRIPSLAPHFGKPAEGPFDKEDQTIPVIGFPTPDEEGNEPPTDDEKKSPLFGKHCIHLLRYVAKLAGVEVSELIQMDLDLFDVQKGTIGGIGKHFLFAPRLDDRLCSFAAMIALICYAKDVNTEESDLFSTVTLYDNEEIGSLTRQGAKGGLLESVVERSSSAFTKKPVDLHTVWANSIILSADVNHLYNPNFPEVYLKNHFPVPNVGITLSLDPNGHMATDVVGTALVEELARRNGDKVQYFQIKNNSRSGGTIGPSLASQTGARTIDLGIAQLSMHSIRAATGSKDVGLGVKFFNGFFKHWRSVYDEFGEL

SEQ ID NO: 1575 - protein, 525 aa, Saccharomyces cerevisiae
  source: /note="strain ATCC 204508 / S288c"
MAAGEQVSNMFDTILVLDFGSQYSHLITRRLREFNIYAEMLPCTQKISELGWTPKGVILSGGPYSVYAEDAPHVDHAIFDLNVPILGICYGMQELAWINGKQVGRGDKREYGPATLKVIDDSNSLFKGMNDSTVWMSHGDKLHGLPTGYKTIATSDNSPYCGIVHETKPIYGIQFHPEVTHSTQGKTLLKNFAVDLCHAKQNWTMENFIDTEINRIRKLVGPTAEVIGAVSGGVDSTVASKLMTEAIGDRFHAILVDNGVLRLNEAANVKKTLVEGLGINLMVVDASEEFLSKLKGVTDPEKKRKIIGNTFIHVFEREAEKIKPKDGKEIQFLLQGTLYPDVIESISFKGPSQTIKTHHNVGGLLENMKLKLIEPLRELFKDEVRHLGELLGIPHDLVWRHPFPGPGIAIRVLGEVTKEQVEIARKADNIYIEEIKKAGLYNQISQAFACLLPVKSVGVMGDQRTYDQVIALRAIETTDFMTADWFPFEHSFLKKVASRIVNEVDGVARVTYDITSKPPATVEWE

SEQ ID NO: 1576 - protein, 554 aa, Saccharomyces cerevisiae
  source: /note="strain ATCC 204508 / S288c"
MVKVSLDNVKLLVDVDKEPFFKPSSTTVGDILTKDALEFIVLLHRTFNNKRKQLLENRQVVQKKLDSGSYHLDFLPETANIRNDPTWQGPILAPGLINRSTEITGPPLRNMLINALNAPVNTYMTDFEDSASPTWNNMVYGQVNLYDAIRNQIDFDTPRKSYKLNGNVANLPTIIVRPRGWHMVEKHLYVDDEPISASIFDFGLYFYHNAKELIKLGKGPYFYLPKMEHHLEAKLWNDVFCVAQDYIGIPRGTIRATVLIETLPAAFQMEEIIYQLRQHSSGLNCGRWDYIFSTIKRLRNDPNHILPNRNQVTMTSPFMDAYVKRLINTCHRRGVHAMGGMAAQIPIKDDPAANEKAMTKVRNDKIRELTNGHDGSWVAHPALAPICNEVFINMGTPNQIYFIPENVVTAANLLETKIPNGEITTEGIVQNLDIGLQYMEAWLRGSGCVPINNLMEDAATAEVSRCQLYQWVKHGVTLKDTGEKVTPELTEKILKEQVERLSKASPLGDKNKFALAAKYFLPEIRGEKFSEFLTTLLYDEIVSTKATPTDLSKL

SEQ ID NO: 1577 - protein, 587 aa, Saccharomyces cerevisiae
  source: /note="strain ATCC 204508 / S288c"
MLWKRTCTRLIKPIAQPRGRLVRRSCYRYASTGTGSTDSSSQWLKYSVIASSATLFGYLFAKNLYSRETKEDLIEKLEMVKKIDPVNSTLKLSSLDSPDYLHDPVKIDKVVEDLKQVLGNKPENYSDAKSDLDAHSDTYFNTHHPSPEQRPRIILFPHTTEEVSKILKICHDNNMPVVPFSGGTSLEGHFLPTRIGDTITVDLSKFMNNVVKFDKLDLDITVQAGLPWEDLNDYLSDHGLMFGCDPGPGAQIGGCIANSCSGTNAYRYGTMKENIINMTIVLPDGTIVKTKKRPRKSSAGYNLNGLFVGSEGTLGIVTEATVKCHVKPKAETVAVVSFDTIKDAAACASNLTQSGIHLNAMELLDENMMKLINASESTDRCDWVEKPTMFFKIGGRSPNIVNALVDEVKAVAQLNHCNSFQFAKDDDEKLELWEARKVALWSVLDADKSKDKSAKIWTTDVAVPVSQFDKVIHETKKDMQASKLINAIVGHAGDGNFHAFIVYRTPEEHETCSQLVDRMVKRALNAEGTCTGEHGVGIGKREYLLEELGEAPVDLMRKIKLAIDPKRIMNPDKIFKTDPNEPANDYR

SEQ ID NO: 1578 - protein, 592 aa, Saccharomyces cerevisiae
  source: /note="strain ATCC 204508 / S288c"
MSELENAHQGPLEGSATVSTNSNSYNEKSGNSTAPGTAGYNDNLAQAKPVSSYISHEGPPKDELEELQKEVDKQLEKKSKSDLLFVSVCCLMVAFGGFVFGWDTGTISGFVRQTDFIRRFGSTRANGTTYLSDVRTGLMVSIFNIGCAIGGIVLSKLGDMYGRKIGLMTVVVIYSIGIIIQIASIDKWYQYFIGRIISGLGVGGITVLAPMLISEVSPKQLRGTLVSCYQLMITFGIFLGYCTNFGTKNYSNSVQWRVPLGLCFAWSIFMIVGMTFVPESPRYLVEVGKIEEAKRSLARANKTTEDSPLVTLEMENYQSSIEAERLAGSASWGELVTGKPQMFRRTLMGMMIQSLQQLTGDNYFFYYGTTIFQAVGLEDSFETAIVLGVVNFVSTFFSLYTVDRFGRRNCLLWGCVGMICCYVVYASVGVTRLWPNGQDQPSSKGAGNCMIVFACFYIFCFATTWAPVAYVLISESYPLRVRGKAMSIASACNWIWGFLISFFTPFITSAINFYYGYVFMGCMVFAYFYVFFFVPETKGLTLEEVNEMYEENVLPWKSTKWIPPSRRTTDYDLDATRNDPRPFYKRMFTKEK

SEQ ID NO: 1579 - protein, 595 aa, Saccharomyces cerevisiae
  source: /note="strain ATCC 204508 / S288c"
MPTVSVNKQQLFDLLGKNYTSQEFDELCFEFGMEMDEDTTEEALKTGEEPELKLDISANRYDLLCIEGISQSLNEYLERKERPDYKLSKPTTKLIIDKSTEQIRPFATAAVLRNIKLNEKSYASFIALQDKLHANLCRNRSLVAMGTHDLDSIEGPFHYRALPPKDIKFVPLNQTQEFTGDKLIEFYKSPEQKNNIGRYVHIIEDSPVFPVIMDSKDRVCSLPPLINSEHSKISVNTRNILIDITATDKTKAEIVLNILTTMFSRYCDEPFTVEPVEIVSEHNGQSRLAPNFNDRIMDVSIKYINSCLGLDQSADEIAHCLKKMSLHAVQSKEDKDILHVDIPVTRPDILHACDIMEDAAVGYGFNNLPKGEKLSNANFIAKPLPINKVSDIFRVASSQATWVEVLPLTLCSHDENFKFLRQSDNGDLAVKLANPKTLEYQVVRTTLLPGILKTVKENRKHSLPIKVFETGDVVFKDDKLERKAYNERHWAAIYVGKNSGFEIIQGLLGKIMQTFRTEWIADYGAAASGRGYWIEEDDSVKTYFPGRGAKVMFRSKEGAEPKQIGHLGVLHPEVMMNFDVPFAASFVEVNAEVFL

SEQ ID NO: 1580 - protein, 693 aa, Saccharomyces cerevisiae
  source: /note="strain ATCC 204508 / S288c"
MSTPFGLDLGNNNSVLAVARNRGIDVVVNEVSNRSTPSLVGFGPRNRYLGESGKTKQTSNVKNTVENLKRIIGLKFKDPEFDIENKFFTSKLVQLKNGKVGVEVEFGGKTHVFSATQLTAMFIDKVKHTVQEETKSSITDVCLAVPVWYSEEQRYNIADAARIAGLNPVRIVNDVTAAAVSYGVFKNDLPGPEEKPRIIGLVDIGHSTYTCSIMAFRKGEMKVLGTAYDKHFGGRDFDRAITEHFADQFKDKYKIDIRKNPKAYNRILIAAEKLKKVLSANTTAPFSVESVMDDIDVSSQLSREELEELVEPLLKRVTYPITNALAQAKLTVNDIDFVEIIGGTTRIPVLKKSISDVFGKPLSSTLNQDEAVAKGAAFICAIHSPTLRVRPFKFEDIDPYSVSYTWDKQVDDEDRLEVFPANSSYPSTKLITLHRTGDFSMKAVYTHPSKLPKGTSTTIAKWSFTGVKVPKDQDFIPVKVKLRCDPSGLHIIENAYTTEDITVQEPVPLPEDAPEDAEPQFKEVTKTIKKDVLGMTAKTFALNPVELNDLIEKENELRNQDKLVAETEDRKNALEEYIYTLRAKLDDEYSDFASDAEKEKLKNMLATTENWLYGDGDDSTKAKYIAKYEELASLGNIIRGRYLAKEEEKRQALRANQETSKMNDIAEKLAEQRRARAASDDSDDNNDENMDLD

SEQ ID NO: 1581 - protein, 704 aa, Saccharomyces cerevisiae
  source: /note="strain ATCC 204508 / S288c"
MYNIPDNVKGAVEFDPWLKPFADVLSERRYLADKWLYDITHATPDGSYQSLSKFARDSYKSYGLHANPETKEITYKEWAPNAERAFLVGDFNNWDTTSHELKNKDEFGNFTITLHPLPNGDFAIPHDSKIKVMFILPDGSKIFRLPAWITRATQPSKETSKQFGPAYEGRFWNPENPYKFVHPRPKFSESVDSLRIYEAHVGISSPEPKITTYKEFTEKVLPRIKYLGYDAIQLMAIMEHAYYASFGYQVTNFFAASSRFGTPEELKELIDTAHSMGILVLLDVVHSHASKNVEDGLNMFDGSDHQYFHSISSGRGEHPLWDSRLFNYGKFEVQRFLLANLAFYVDVYQFDGFRFDGVTSMLYVHHGVGAGGSFSGDYNEYLSRDRSFVDHEALAYLMLANDLVHEMLPNLAVTVAEDVSGYPTLCLPRSIGGTGFDYRLAMALPDMWIKLIKEKKDDEWEMGSIVYTLTNRRYGEKVVAYCESHDQALVGDKTLAFWLMDAAMYTDMTVLKEPSIVIDRGIALHKMIRLITHSLGGEAYLNFEGNEFGHPEWLDFPNVNNGDSYKYARRQFNLADDPLLRYQNLNEFDRSMQLCEKRHKWLNTKQAYVSLKHEGDKMIVFERNNLLFIFNFHPTNSYSDYRVGVEKAGTYHIVLNSDRAEFGGHNRINESSEFFTTDLEWNNRKNFLQVYIPSRVALVLALKE

SEQ ID NO: 1582 - protein, 816 aa, Saccharomyces cerevisiae
  source: /note="strain ATCC 204508 / S288c"
MLFNINRQEDDPFTQLINQSSANTQNQQAHQQESPYQFLQKVVSNEPKGKEEWVSPFRQDALANRQNNRAYGEDAKNRKFPTVSATSAYSKQQPKDLGYKNIPKNAKRAKDIRFPTYLTQNEERQYQLLTELELKEKHLKYLKKCQKITDLTKDEKDDTDTTTSSSTSTSSSSSSSSSSSSSSSSDEGDVTSTTTSEATEATADTATTTTTTTSTSTTSTSTTNAVENSADEATSVEEEHEDKVSESTSIGKGTADSAQINVAEPISSENGVLEPRTTDQSGGSKSGVVPTDEQKEEKSDVKKVNPPSGEEKKEVEAEGDAEEETEQSSAEESAERTSTPETSEPESEEDESPIDPSKAPKVPFQEPSRKERTGIFALWKSPTSSSTQKSKTAAPSNPVATPENPELIVKTKEHGYLSKAVYDKINYDEKIHQAWLADLRAKEKDKYDAKNKEYKEKLQDLQNQIDEIENSMKAMREETSEKIEVSKNRLVKKIIDVNAEHNNKKLMILKDTENMKNQKLQEKNEVLDKQTNVKSEIDDLNNEKTNVQKEFNDWTTNLSNLSQQLDAQIFKINQINLKQGKVQNEIDNLEKKKEDLVTQTEENKKLHEKNVQVLESVENKEYLPQINDIDNQISSLLNEVTIIKQENANEKTQLSAITKRLEDERRAHEEQLKLEAEERKRKEENLLEKQRQELEEQAHQAQLDHEQQITQVKQTYNDQLTELQDKLATEEKELEAVKRERTRLQAEKAIEEQTRQKNADEALKQEILSRQHKQAEGIHAAENHKIPNDRSQKNTSVLPKDDSLYEYHTEEDVMYA

SEQ ID NO: 1583 - protein, 809 aa, Saccharomyces cerevisiae
  source: /note="strain ATCC 204508 / S288c"
MSSVEELTQLFSQVGFEDKKVKEIVKNKKVSDSLYKLIKETPSDYQWNKSTRALVHNLASFVKGTDLPKSELIVNGIINGDLKTSLQVDAAFKYVKANGEASTKMGMNENSGVGIEITEDQVRNYVMQYIQENKERILTERYKLVPGIFADVKNLKELKWADPRSFKPIIDQEVLKLLGPKDERDLIKKKTKNNEKKKTNSAKKSSDNSASSGPKRTMFNEGFLGDLHKVGENPQAYPELMKEHLEVTGGKVRTRFPPEPNGYLHIGHSKAIMVNFGYAKYHNGTCYLRFDDTNPEKEAPEYFESIKRMVSWLGFKPWKITYSSDYFDELYRLAEVLIKNGKAYVCHCTAEEIKRGRGIKEDGTPGGERYACKHRDQSIEQNLQEFRDMRDGKYKPGEAILRMKQDLNSPSPQMWDLIAYRVLNAPHPRTGTKWRIYPTYDFTHCLVDSMENITHSLCTTEFYLSRESYEWLCDQVHVFRPAQREYGRLNITGTVLSKRKIAQLVDEKFVRGWDDPRLFTLEAIRRRGVPPGAILSFINTLGVTTSTTNIQVVRFESAVRKYLEDTTPRLMFVLDPVEVVVDNLSDDYEELATIPYRPGTPEFGERTVPFTNKFYIERSDFSENVDDKEFFRLTPNQPVGLIKVSHTVSFKSLEKDEAGKIIRIHVNYDNKVEEGSKPKKPKTYIQWVPISSKYNSPLRVTETRVYNQLFKSENPSSHPEGFLKDINPESEVVYKESVMEHNFGDVVKNSPWVVDSVKNSEFYVEEDKDSKEVCRFQAMRVGYFTLDKESTTSKVILNRIVSLKDATSK

SEQ ID NO: 1584 - protein, 946 aa, Saccharomyces cerevisiae
  source: /note="strain ATCC 204508 / S288c"
MAGQVLDGKACAQQFRSNIANEIKSIQGHVPGFAPNLAIIQVGNRPDSATYVRMKRKAAEEAGIVANFIHLDESATEFEVLRYVDQLNEDPHTHGIIVQLPLPAHLDEDRITSRVLAEKDVDGFGPTNIGELNKKNGHPFFLPCTPKGIIELLHKANVTIEGSRSVVIGRSDIVGSPVAELLKSLNSTVTITHSKTRDIASYLHDADIVVVAIGQPEFVKGEWFKPRDGTSSDKKTVVIDVGTNYVADPSKKSGFKCVGDVEFNEAIKYVHLITPVPGGVGPMTVAMLMQNTLIAAKRQMEESSKPLQIPPLPLKLLTPVPSDIDISRAQQPKLINQLAQELGIYSHELELYGHYKAKISPKVIERLQTRQNGKYILVSGITPTPLGEGKSTTTMGLVQALTAHLGKPAIANVRQPSLGPTLGVKGGAAGGGYSQVIPMDEFNLHLTGDIHAIGAANNLLAAAIDTRMFHETTQKNDATFYNRLVPRKNGKRKFTPSMQRRLNRLGIQKTNPDDLTPEEINKFARLNIDPDTITIKRVVDINDRMLRQITIGQAPTEKNHTRVTGFDITVASELMAILALSKDLRDMKERIGRVVVAADVNRSPVTVEDVGCTGALTALLRDAIKPNLMQTLEGTPVLVHAGPFANISIGASSVIADRVALKLVGTEPEAKTEAGYVVTEAGFDFTMGGERFFNIKCRSSGLTPNAVVLVATVRALKSHGGAPDVKPGQPLPSAYTEENIEFVEKGAANMCKQIANIKQFGVPVVVAINKFETDTEGEIAAIRKAALEAGAFEAVTSNHWAEGGKGAIDLAKAVIEASNQPVDFHFLYDVNSSVEDKLTTIVQKMYGGAAIDILPEAQRKIDMYKEQGFGNLPICIAKTQYSLSHDATLKGVPTGFTFPIRDVRLSNGAGYLYALAAEIQTIPGLATYAGYMAVEVDDDGEIDGLF

SEQ ID NO: 1585 - protein, 983 aa, Saccharomyces cerevisiae
  source: /note="strain ATCC 204508 / S288c"
MTSTTGLRNLTLSFKKQLTTSTRTIMTIGDKQKWTATNVRNTFLDYFKSKEHKFVKSSPVVPFDDPTLLFANAGMNQYKPIFLGTVDPASDFYTLKRAYNSQKCIRAGGKHNDLEDVGKDSYHHTFFEMLGNWSFGDYFKKEAITYSWTLLTEVYGIPKDRLYVTYFEGDEKLGLEPDTEARELWKNVGVPDDHILPGNAKDNFWEMGDQGPCGPCSEIHYDRIGGRNAASLVNMDDPDVLEVWNLVFIQFNREQDGSLKPLPAKHIDTGMGFERLVSVLQDVRSNYDTDVFTPLFERIQEITSVRPYSGNFGENDKDGIDTAYRVLADHVRTLTFALADGGVPNNEGRGYVLRRILRRGARYARKYMNYPIGNFFSTLAPTLISQVQDIFPELAKDPAFLFEILDEEEASFAKTLDRGERLFEKYASAASKTESKTLDGKQVWRLYDTYGFPVDLTELMAEEQGLKIDGPGFEKAKQESYEASKRGGKKDQSDLIKLNVHELSELNDAKVPKTNDEFKYGSANVEGTILKLHDGTNFVDEITEPGKKYGIILDKTCFYAEQGGQEYDTGKIVIDDAAEFNVENVQLYNGFVFHTGSLEEGKLSVGDKIIASFDELRRFPIKNNHTGTHILNFALKETLGNDVDQKGSLVAPEKLRFDFSHKKAVSNEELKKVEDICNEQIKENLQVFYKEIPLDLAKSIDGVRAVFGETYPDPVRVVSVGKPIEELLANPANEEWTKYSIEFCGGTHVNKTGDIKYFVILEESGIAKGIRRIVAVTGTEAFEAQRLAEQFAADLDAADKLPFSPIKEKKLKELGVKLGQLSISVITKNELKQKFNKIEKAVKDEVKSRAKKENKQTLDEVKTFFETNENAPYLVKFIDISPNAKAITEAINYMKSNDSVKDKSIYLLAGNDPEGRVAHGCYISNAALAKGIDGSALAKKVSSIIGGKAGGKGNVFQGMGDKPAAIKDAVDDLESLFKEKLSI

SEQ ID NO: 1586 - protein, 1014 aa, Saccharomyces cerevisiae
  source: /note="strain ATCC 204508 / S288c"
MLRFVSSQTCRYSSRGLLKTSLLKNASTVKIVGRGLATTGTDNFLSTSNATYIDEMYQAWQKDPSSVHVSWDAYFKNMSNPKIPATKAFQAPPSISNFPQGTEAAPLGTAMTGSVDENVSIHLKVQLLCRAYQVRGHLKAHIDPLGISFGSNKNNPVPPELTLDYYGFSKHDLDKEINLGPGILPRFARDGKSKMSLKEIVDHLEKLYCSSYGVQYTHIPSKQKCDWLRERIEIPEPYQYTVDQKRQILDRLTWATSFESFLSTKFPNDKRFGLEGLESVVPGIKTLVDRSVELGVEDIVLGMAHRGRLNVLSNVVRKPNESIFSEFKGSSARDDIEGSGDVKYHLGMNYQRPTTSGKYVNLSLVANPSHLESQDPVVLGRTRALLHAKNDLKEKTKALGVLLHGDAAFAGQGVVYETMGFLTLPEYSTGGTIHVITNNQIGFTTDPRFARSTPYPSDLAKAIDAPIFHVNANDVEAVTFIFNLAAEWRHKFHTDAIIDVVGWRKHGHNETDQPSFTQPLMYKKIAKQKSVIDVYTEKLISEGTFSKKDIDEHKKWVWNLFEDAFEKAKDYVPSQREWLTAAWEGFKSPKELATEILPHEPTNVPESTLKELGKVLSSWPEGFEVHKNLKRILKNRGKSIETGEGIDWATGEALAFGTLVLDGQNVRVSGEDVERGTFSQRHAVLHDQQSEAIYTPLSTLNNEKADFTIANSSLSEYGVMGFEYGYSLTSPDYLVMWEAQFGDFANTAQVIIDQFIAGGEQKWKQRSGLVLSLPHGYDGQGPEHSSGRLERFLQLANEDPRYFPSEEKLQRQHQDCNFQVVYPTTPANLFHILRRQQHRQFRKPLALFFSKQLLRHPLARSSLSEFTEGGFQWIIEDIEHGKSIGTKEETKRLVLLSGQVYTALHKRRESLGDKTTAFLKIEQLHPFPFAQLRDSLNSYPNLEEIVWCQEEPLNMGSWAYTEPRLHTTLKETDKYKDFKVRYCGRNPSGAVAAGSKSLHLAEEDAFLKDVFQQS

SEQ ID NO: 1587 - protein, 1083 aa, Saccharomyces cerevisiae
  source: /note="strain ATCC 204508 / S288c"
MSSEDIIYDPQFKPVQGIYENRLRQFIDTGGDYHDLNLPKFYDKKRISLDHDHVKVWWYQVSFERGSSPVSPDKRPSWKSIIERDKKGELEFREANINQPFGPSWSTTWFKVKISLPEDWVKSNEQLLFQWDCSNEGIVIDPKTLIPVTAFSGGERTEYVLPKTSDGKHFFYIEAGNNGMFGCGAGSTINPPDDNRFFHLRKADIVWPDLDARALYIDFWMLGDAARELPGDSWQKHQARQLGNAVMNLFDPNDRSSVRKCRELLQREYFDSFLESSKVYEQGESQVLTNVYGIGNCHIDTAWLWPFAETRRKIVRSWSSQCTLMDRFPEYKFVASQAQQFKWLLEDHPEFFNKVLIPKIQQSQFFAVGGTWVENDTNIPSGESLARQFFFGQRFFLKHFGLKSKIFWLPDTFGYSSQMPQLCRLSGIDKFLTQKLSWNNINSFPHSTFNWAGIDGSQLLTHMPPGNTYTADSHFGDVLRTAKQNKTPEYYGSGLMLYGKGDGGGGPTEEMLQKMRRIRSMNNRNGNVIPKLQVGITVDEFYDDILKRTNQGHDLPTWSGELYFEFHRGTYTSQAQTKKLMRLSEIKLHDLEWIAAKTSVLYPDSYKYPSKQINELWENVLLCQFHDVLPGSCIEMVYKYEAVPMLHNVVKECTSLIDKTVQFLQSQSKADLVEMRTLTWSKPEKVSEECSLNGSYTSSVTGYDDYIVLANGKLKVIICKKTGVITSITDETLGVEYLDTEHGRNKLGANQFVIYDDKPLGWQAWDTELYSVNQYKYVTKPKKVQVSCNTKEKCAVEVIFQISEKCKIKSVISLNATAVTDAKLSKVDISTTVENWDARNKFLKVEFPVNIRNDFASYETQFGITKRPTHYNTSWDVAKFEVCHHKFADYSEYSKGVSILNDCKYGFSTHGNLMRLSLLRSPKAPDAHADMGTHEIKYAIYPHRGALSSDTVKLAHEFNYCFKYKLPKDIGMNFDDIISISGDENVILSNIKRGEDDSAVKSNYSLNPRDEQSIVVRVYESLGGESFASLNTTLNLKRIEKVDNLEMKVYKSLTATRDESNHAINRIPIKLRPFEIASFRLYF

SEQ ID NO: 1588 - protein, 589 aa, Lactobacillus acidophilus
  source: /note="strain 30SC"
MKKTKIVSTLGPASNDIETITALAKAGANVFRFNFSHGDHPEHLARMKMVRQVEKDTGLLLGIDLDTKGAEIRTTEQEGGKFTINTGDMIRVSMDATKKGNKDMIHVTYDGLYDDTHVGGHVLIDDGLVDLLIKEKDDSKRELVCEAQNTGVIGSKKGVNAPGVEIRLPGITEKDTDDIKFGLKFGINFITASFARKAQDILDIRKLCEEAGADYVKIFPKIESQEGIDNADEILQVSDGLMVARGDMGVEIPFMEVPFVQKSLIRKANALGKPVITATQMLDSMQENPRPTRAEVSDVANAVLDGTDATMLSGESANGLYPVKAVKAMAEIDERTEKQMLKRNTLALQRFEAYKGSNVTEAIGESVVRTAQELGVKTIITATNSGYTARMISKYRPNADIIALTFDEKIQHSLGIVWGVQPVLTEKPKSTDDMFEVAAKVAKEKGFVKDGDLVIIVAGVPVGDSGTTNLMKLQIIGDKLVQGLGVGNGSVIGKAVVANSAEEANSKVKEGDILVAKTTDPDYNPAIKKASGLVVEASGLTSHAAVIGLSLGIPVVVGATDATSKISDGSTITVDARRGAIYQGEISNL

SEQ ID NO: 1589 - protein, 1217 aa, Lactobacillus acidophilus
  source: /note="strain 30SC"
MIDVNKFESMQIGLASPNKIRSWSYGEVKKPETINYRTLKPEKDGLFDERIFGPTKDWSCACGKYKGVRYRGIVCDRCGVEVTSSKVRRERMGHIELAAPVTHIWYFKGIPSRMGLVLDISPRLLEEVIYFAAYIVIDPGDTDLEPKQLLTEAEYREQKAKYGNRFVAKMGAEAIRDLLKKVDLDKEVKDLKKELQTATGQKRTRAIRRLDILDAFKNSGNKPEWMVMDAVPVIPPDLRPMVQLEGGRFATSDLNDLYRRVINRNNRLKRLLDLNAPNIIVQNEKRMLQEAVDALIDNGRRGRPVVGPGNRPLKSLSHMLKGKQGRFRQNLLGKRVDYSGRSVIDVSPKLKFYQCGVPRPMALELFKPFVMHELVKRGIASNIKNAKRKIDREDDDIWDVLEDVIKERPVLLNRAPTLHRLSIQAFEPVLVSGKSIRLHPLACEAYNADFDGDQMAIHVPLSDEAVAESRLLMLAAHHILAPKDGKPIVTPSQDIVLGNYWLTQAERGREGEGMIFSSPAEATVAYENGDIHYHTIIGMSADSMPKKPWPKGHEHGIFITTYGKIVFNQLFPDDYFYINEPTEKNLNNPLDAKYFLDEGEDIKDRIDKVADYLIASPFKSSFLSDSIATIYKYYKVQRTSEYLDDLKKLGYTSSTTSGITIGMNDVPEIHDKDEKVAKARKQVDIVSKQFRRGLITEQERHDRVISIWNACKDEIQNEIAQIHSPRNPISIMADSGARGNISNFTQLAGMRGLMATPNGGLFEIPVTSNFKEGLSVLELFMSTHGARKGMTDTALKTAQSGYLTRRLVDVAQDVIIREDDCGTDRGITVSAIMEGDELIEPLFDRLLGRFTAETVKDPKTGEAIVGKDVMMDEAMAHKICDAGVTHVKIRSILTCDTPHGVCRKCYGMNLATGEEVEVGEAVGTVAAQSIGEPGTQLTLRTFHNGGVAGAEDITQGLPRVQELFEARNPKGRATVSEVDGVVDSIQENPAEHTREITVKGKIDTRSYSVPYTASVAVAEGDTVHRGDKLTLGSVDPKELIQVTDTLTTEKYILAEVQKAYRMQGVDISDKHVEVLTRQMLQKVRVLDPGETDILPGEVMDIGQFRDRNKEVIISGGIPATAQSVILGITKAALETNSFLSAASFQETTRVLTDASIRGKNDPLLGLKENVIIGKIIPAGTGMPVYRSMEPEADVKKPDSVYSIADIEKQMKEKDKAK

SEQ ID NO: 1590 - protein, 278 aa, Lactobacillus acidophilus
  source: /note="strain 30SC"
MAIKIYKPTTNGRRHMTSSDFAEITKTKPEKTLLESQSHTAGRNSYGHITVRHRGGGHKQKYRIIDFKRNKDNAKAVVKAIEYDPNRTANIALLHYTDGIKAYILAPKGLKVGDIVESGDEVDIKPGNALALKNIPTGTAIHNIELKPGKGGQLVRSAGASAQVLGVDGDYTLIRLQSGEVRKILSSCRATIGVVGNEQHSLIQLGKAGRKRWLGKRPQSRGSVMNPNDHPHGGGEGKAPVGRPQPMTPWGKKARGIKTRDIKKASEKLIIRHRKGSK

SEQ ID NO: 1591 - protein, 338 aa, Lactobacillus acidophilus
  source: /note="strain 30SC"
MTVKIGINGFGRIGRLAFRRIMDLGEKTKDIEVVAINDLTTPAMLAYLLKYDTTHGTFNHEVSSTDDSIVVDGKKYRVYAEPQAQNIPWVKNDGVDFVLECTGFYTSKAKSQAHLDAGAKRVLISAPAGNDLKTIVYSVNENTLTADDKIVSAASCTTNSLAPMANALDKEFGIEVATMTTIHAYTGTQMTLDGPSRSGKEQDARAAAENIIPHTTGSAKAIGLVLPNLNGKMNGHAQRVPVPDGSETELVSILKKKVTADEVNEAMKKYESPSFAYNGDHIVSSDVINMTAGSIFDPTQTMVTTAGDKQLVKTVAWYDNEYSFTCQMVRTLLHFATL

SEQ ID NO: 1592 - protein, 428 aa, Lactobacillus acidophilus
  source: /note="strain 30SC"
MLKSVIENVHALEIFDSRGNPTVEVHVTLSNGVVGKAEVPSGASTGENEAVELRDGGSRLGGKGVSKAVNNVNTEINDALKGMDPFDQAKIDQTMIDLDGTPNKGRLGANAILGVSMATAVAAAKANHQPLYRYLGGIDLEMPQTFHNVINGGEHADNGIDIQEFMITPIAKTSFRDGFEKIVNVYHTLKKVLEDMGYETGLGDEGGFAPNMKNSEEALKALHESIVKAGYKPGEDIGIACDCAASYFYNKEDGKYHLEGKVLDDEELAAYYDKLLDEFPELMSMEDPYDENDVEGMVKFTQSHKDRIQIVLDDFICTNPALLKKAIKEGAGNASLIKLNQIGTVTETLETIRMSRKNGYNTMISHRSGETGDTFIADLAVAINGGQLKTGAPARSERVEKYNRLLEIEEELGKGERLAFFPDDVDHD

SEQ ID NO: 1593 - protein, 396 aa, Lactobacillus acidophilus
  source: /note="strain 30SC"
MAEKEHYVRTKPHVNIGTIGHVDHGKTTLTAAITTVLAEKGLAKAEDYSQIDAAPEEKERGITINTAHVEYETENRHYAHMDAPGHADYIKNMITGAAQMDGAILVVAATDGPMPQTREHILLARQVGVNYIVVFLNKCDLVDDPELIDLVEMEVRDLLTEYDYPGDDIPVVRGSALKALQGDKEAQEQILKLMDIVDEYIPTPERQTDKPFLMPVEDVFTITGRGTVASGRIDRGTVKIGDEVEIVGLVDKVLKSVVTGLEMFHKTLDLGEAGDNVGVLLRGIDRDQVVRGQVLAAPGSIQTHEKFKGQVYVLKKDEGGRHTPFFSDYRPQFYFHTTDITGEIELPEGTEMVMPGDNTEFTVTLIKPAAIEKGTKFTIREGGRTVGAGQVTEILD

SEQ ID NO: 1594 - protein, 403 aa, Lactobacillus acidophilus
  source: /note="strain 30SC"
MSENSNQFLDALKQMQGVEVGDIVNVEVLDVEDGQIDVGVENAGVEGVITRREYTSDRNADLRDLVKPGDKFKALVLRRAGGDKENGEFFFSVTRLKEREAYDKLQKDFEEGKAIEGTVTSSVRGGLLVDVGTRGFLPASLISNRYVSDLKPYIGKTMKLKITEIDPNKNRLILSHKDLVEEEREEAFDKVASQLVVGDVIEGKVSRLTNFGAFIDVGGVDGLVHISEISYKHVDKPSDALKAGQDVKVKVIGIDNDRHRISLSIKQTEPSPFEQATANLNEGDVFEGEVKSLTNFGAFVEVADGIQGLVHVSEISNKHVDKPSDVLKVGQTVKVKVLNIDPSDRRISLSIKAADSNTSSSDNNSSRPRRSRNENSVNKKYMSDNDNGFALGDIIGDQLKDRK

SEQ ID NO: 1595 - protein, 257 aa, Lactobacillus acidophilus
  source: /note="strain 30SC"
MADVVTMKQLLEAGVHFGHQTRRWNPKMAPYIFTQRNGIYIIDLQKTIKMLDDAYNFMKAVAQDGGVFLFVGTKKQAQDSIAEEATRAGQYYVNQRWLGGTLTNWTTIQSRVRRLKQLKEMSQDGTFDVLPKKEVALLTKEMDKLEKFLGGIEDMPRIPDVLFVVDPKKEKIAVHEANILGIPVVAMVDTNTDPDPIDVVIPSNDDAIRAIRLIAGAMADAIVEGKQGQDDETVEVDFKENADGSDEIVSAEENPED

SEQ ID NO: 1596 - protein, 118 aa, Lactobacillus acidophilus; identical to SEQ ID NO: 580
  source: /note="strain 30SC"

SEQ ID NO: 1597 - protein, 230 aa, Lactobacillus acidophilus
  source: /note="strain 30SC"
MPKHGKKYLDAAKKVDSNKLYSVAEAMKLVKETSYANFDATVDVAYNLSVDPKQADQQIRGSLVLPNGTGKTQTVVVFAEGPQADQAKAAGADFVGSDDLVQKIQDGWLDFDVVVATPMMMAKVGRLGRILGPKGLMPNPKTGTVTMDIEKAVKNVKAGQVEYRVDRQAAIHTPIGKVSFTEDQLVENFDALRDVILRARPASAKGQYIKSVAISATFGPGIKLDPLNLN

SEQ ID NO: 1598 - protein, 337 aa, Lactobacillus acidophilus
  source: /note="strain 30SC"
MELILPEDYRPTLTVRDTEAAIVYIRETFQDKLASILGVQRMSAPMFVEKNTGLNDNLNGVERPVAFDMKAMPKDDTIEVVHSLAKWKRLALKRYGFGMHEGLYTNMNAIRRDEDLDNFHSIYVDQWDWEKIIRKEERNTDTLEITVNKIFRAIKETEKLVSARYPGSTYRLGDHVSFITTQELEDRWPELSPEEREDRIAKEEKAVFIMKIGDKLKRSGKPHDGRAPDYDDWQLNGDLVFWYEPLQKKLEISSMGIRVSEESLREQLKKAHCEERAKLPFHQMLLKGKLPYTIGGGIGQSRLCMLLLGKAHIGEVQASIWPKNMVEKCEADHIHLL

SEQ ID NO: 1599 - protein, 744 aa, Lactobacillus acidophilus
  source: /note="strain 30SC"
MPSTRIELDQNFIDQVKHEIKPHWGELGWVTYKRTYARWLPDQDRSENWDETVKRVIEGNINLDPRLKDSPSKEVISELTNEAKRLFRLVYGLSATPSGRNLWISGTDYQKRTGDSLNNCWFIAIRPQEYGDSHIVPSYVDKREKAVSMPFSFLFDQLMKGGGVGFSVVNDNIKQIPKVNNKIDLTVVIDKGSKSHDASIKVGAVDKDEWKKQNPDQDDVIYYRLPDTREGWVLANARLIDMHFNPTNPDRKTKLVLDITDIRPYGAKIHGFGGTASGPMPLVEMFIDINNVINARAGKNLTAVDATDICNLIGKTVVAGNVRRSAELALGSSDDQDFIKMKQDKKKLYHHRWASNNSVAINSKFNNYGPIADGILHNGEPGIVNLDLSRNYGRIVDGYQPGIDDDVEGTNPCGEISLANGEPCNLFEVFPYIAEMQGWDLKEAFALATRFAKRVTFSHYDWEVSRKIIQKNRRIGISMSGIQDWLLNDLGHRVVTGFEDAVDAETGEKIKKPIYDSQAVERVDGLYKAVVDADKAYSKELGTHPSIKHTTVKPSGTVAKLAGVSEGMHFHYAGYLIQRIRFQASDPLLPALRECGYHTEPDIYTKNTICVEFPLRAAHADSKNFASAGTVSIAEQFATQAFLQTYWSDNAVSCTITFQSDESDEIAPLLHQYRHTIKSTSLLPYYGGSLKQAPKEPIDKKTYKERAALITDDVEEVFAKQNDDQKGLEIVGQTDCEGGACPIK

SEQ ID NO: 1600 - protein, 323 aa, Lactobacillus acidophilus
  source: /note="strain 30SC"
MARVEKPRKVILVGDGAVGSTFAFSMVQQGIAEELGIIDIAKEHVQGDAIDLADATPWTYPKNIYAADYPDCKDADLIVITAGAPQKPGETRLDLVNKNLKILSSIVEPIVESGFDGIFLVVANPVDILTHATWKISGFPKDRVIGSGTSLDTGRLQKVIGEMEHVDPRSVNAYMLGEHGDTEFPAWSYNNVGGVKVSDWVKAHGMDESKLEDIHKEVANMAYDIINKKGATFYGIGTASAMIAKAILNDEHRVLPLSVAMDGQYGLHDLHIGTPAVVGRKGLEQIIEMPLSDDEQAKMEASAKQLKEVMDKAFKETGVKVRQ

SEQ ID NO: 1601 - protein, 176 aa, Lactobacillus acidophilus
  source: /note="strain 30SC"
MSRIGLKTIEVPDSVTVTKEGDNITVKGPKGELTRYFDPKITFEQKDGKINFSRSSESDKALHGTERANLASMIEGVVDGYKKTLKLIGVGYRAQAQGNKITLNVGYSHPVVLTAPEGVSVKATSATDVEVEGVSKQDVGQFAAEIRAVRPPEPYKGKGIRYVDEYVRRKEGKTGK

SEQ ID NO: 1602 - protein, 320 aa, Lactobacillus acidophilus
  source: /note="strain 30SC"
MKRIGILTSGGDAPGMNAAIRAVTKTAIHHGLEVFGIRYGFAGLVAGDFVPLTTENVDHKINEGGTFLYSARFPEFAQEEVQQKGVEQLKKHGIDAVIVIGGDGSYHGALALTRHGVNSVGLPGTIDNDIPYTDYTIGFDSACRTAMDAIDKIRDTASSHHRVFIVNVMGRECGDIAMRVGVASGADAIVIPERPYDIKEIAETLKRGFADGKDHGIIVLAEGVMAADKFKDELLKYGDFDARANVLAHMQRGGSPTVTDRVNATKMGNYAVKLLLDGKGGLAVGIENSKLETHDILDLFDGKHQGDYALMDVNEEMTKY

SEQ ID NO: 1603 - protein, 867 aa, Lactobacillus acidophilus
  source: /note="strain 30SC"
MAKKRIYEVAKEVGVDNKVVVQKAKDLGFDVKNHMSSIDDVQAAKLKSSFQNSAPAKKNNKIKISVSSIRKNEKKQENNNSSKKPRRRNNKRRQNNDRNRDNRNERGNNRANSGKPKAAALLQQFKQKQRAEEGQLNKEAQKAKKEYHEQLKHPKQEQPVKNNKKTNNDNNKKKSAPVEKKVIGPKILKPSPARLKQNQPSANERVAAKVTMPEAPKDDRRGNGHGRNTGKPGRKGKNQFFNGHSEHSDRSERKRRKNKKKQQEQKPKKQPTKRKERPLPEVLVYEEGMNAQDLGKLLHREPAEIVKKLFMLGVLTNQNQSLDKDTIELLAAEYGIDAKQKVHEDISDIDTLYNKRMEESKKSKNQVKRPPVVTIMGHVDHGKTTLLDRLRHTHVSAHEAGGITQKIGAYQVRLDNRLITFLDTPGHAAFSNMRARGAEITDIVVLVVAADDGVMPQTVEAIDHAKSANVPIIVAINKMDKPGANPQHVTEELMKYNLIPEDYGGDTIFVNISAKTGQNVDDLLQMILLQADVMELKANPTEMAIGTVIEARLSRGRGPVADVLIQQGTLNIGDPIVVGDTFGRVRTMTNDRGRQVKKATPSEPVEITGLNDVPESADKLVEFKDEKTARSVGEARAQQSLQKSREKVQHVTLDNLFDTMKKENMKEVDIVLKADVQGSVEALQQSLEKIEVEGVRVNIIHSGVGAINESDVTLAGASNAFIIGFNVRPTATAKSQAETDSVDIRLYSVIYKAIDDVTAAMKGMLEPTYEEKVIGNLTVRETWKVSKVGTIAGSFVDKGVVKNDSKIRVIRDGIVKYDGEIASLKRFKDDVKEVKQGNDCGLTIKDYNDIKVGDEFEVYEMQQVEPK

SEQ ID NO: 1604 - protein, 473 aa, Lactobacillus acidophilus
  source: /note="strain 30SC"
MKKNLRIVSVAAAALLAVAPVAASAVSTVSAADATTTTTATTTTNKPTVDLSGAGSVSESKDTVNVTPSFTLTSAIGANGAVTTPATLKGTTPATLKGTITASLNGTSVTADVASAAKSVELTNQSGAPVYSYDAKADKIVNHLGDWDKSANSVYVVAGQTYTMTLSDVGFNFGKANAGKTLTFNVPGNVKVEGGTYKDGKVTVDQYGNVTGLKFTLSVKAYNSANTSAVSFYDVKSGLVATQGSYMTLAENGDLNVTTLLKELNGKYEALQFQNGKFQSFAATTTADDVKAELEKAGIKVDPAGNFEAPDTFTVTLNAKSEDNGKTASLPVVVTVPNGKSTVVPSVAKTVMHNAYYYDKDAKRVGTDKLTRYNSVTVSPKTTTISGKAYYEVVENGKLSGKFINADNIDGTKRTLKHNAYVYASSKKRANKVVLKKGTEVTTYGGSYTFKNGKQYYKIGNNTDKTYVKASNF

SEQ ID NO: 1605 - protein, 135 aa, Lactobacillus acidophilus; identical to SEQ ID NO: 574
  source: /note="strain 30SC"

SEQ ID NO: 1606 - protein, 697 aa, Lactobacillus acidophilus
  source: /note="strain 30SC"
MANKREFPLAKTRNIGIMAHIDAGKTTTTERILYYTGKIHKIGETHEGDSQMDWMDEEKERGITITSAATTAQWKDHRINIIDTPGHVDFTIEVERSLRVLDGAVTVLDAQAGVEPQTENVWRQAETYGVPRIVFVNKMDKIGADFDKSVKSLHERLNANAHAVQMPIGSADTFEGVIDLINMVADIYDEDKLGSKWDTVPVPDEYKEEAEARRNDLIEAVADVDDGIMEKFLGGEEISNDELKAAIRKATLDLKFFPVYAGSAFKNKGVQMMLDGVIDYLPSPLDVKPYVAHDPKTGDEVELMADDKKPFAALAFKIATDPFVGRLTFIRVYTGSLESGSYVLNASKNSRERVGRLLQMHANSRTEIPEVFSGDIAGAIGLKNTTTGDSLTDPDHPLILESLKVPDPVIQVSVEPKSKADRDKMDVALQKLTEEDPTFRAETNPETGQTLISGMGELHLDIMVERMRREFNVDAKIGEPQVAYRETFTKEAKAQGKFVRQSGGKGQYGDVWIDFTPNEEGKGYEFEDAIVGGVVPREFIPSVDQGLQEAMKNGVLAGYPLIDVKAKLYDGSYHEVDSSEAAFKVAASLALKNAASKAGAVILEPIMKVQVTTPEEYLGDVMGSITARRGTMEGMEDRAGAKIINSFVPLSEMFGYATTLRSSTQGRGTFTMVFDHYSPTPKSIQAEIIKKRGGEAE

SEQ ID NO: 1607 - protein, 168 aa, Lactobacillus acidophilus
  source: /note="strain 30SC"
MANRNDSRNNRRNKDDIEDQLVAVNRITKVVKGGRRMRFAALVVVGDKKGRVGFGTGKAQEVPEAIRKAVEDGKKKMINVPKVGTTIPHEVIGHYGSGNILLKPAEAGSGVAAGGAVRIVMDMAGISDVTSKSLGSNTPINVVRATIDGLKKLRTSEEVEKLRQPERA

SEQ ID NO: 1608 - protein, 212 aa, Lactobacillus acidophilus; identical to SEQ ID NO: 518
  source: /note="strain 30SC"

SEQ ID NO: 1609 - protein, 224 aa, Lactobacillus acidophilus
  source: /note="strain 30SC"
MGQKINPNGFRLGVIRDWESKWYADKGYKETLNEDLRIRKFISEKLKDASVSTVEIERAANRINISIHTAKPGMVIGKGGSEVEALRKQLNALTGKQVHINIVEIKKPDLDAELVADGIARQLEARIAFRRAMRQATQRAMRAGAKGIKVQTSGRLNGADMARREWHTEGRVPLQTLRADIDYAWVNAFTTYGEIGVQVWINRGEVLPTRKNKPASKPAKGGNR

SEQ ID NO: 1610 - protein, 614 aa, Lactobacillus acidophilus
  source: /note="strain 30SC"
MSEKRRDDLRNIAIIAHVDHGKTTLVNQLLKQSDTLPEHMNLEDRAMDSNAIERERGITILSKNTAVRYKDTTINILDTPGHADFGGEVERVMHMVDGALLLVDAYEGPMPQTRFVLKKALEAGVKPIVVLNKIDRPGARPKKVLDDVLELFIELGANDEQLDFPVVYASALNGTSSYDPDPSTQKETMDPIFDTILKYIPAPIDNSDEPLQFQITMLDWDDYVGRIGVGRIYRGKVKVGDNITVMKRDGSTQNFRVTKLFGYFGLKRNEIKEAKAGDIVAISGINDIYVGETIASADHPEALPLLKIDPPTLQMDFVANDSPFAGREGDQVTPKKLEDRLIRQTRTDVSLKVEPTDQLNAWTVSGRGELHLSILVEELRREGFELQLSRPKVIYREIDGTMCEPFESVQVDTPDEYVGSVIDSLSQRKGEMQNMESTGNGQTRLEFLVPSRGLIGYNNEFMSQTGGYGIMNHTFAAYKPVVKNWNPGRRNGALVSINQGQSTTYSLQSVEQRGELFIGAGVEVYEGMIVGQSSRERDIAVNVTKGKNLTNTRAAGKDHAAAIKTPKTLTLEEAIEFLNDDEYCEVTPESIRLRKKILNTSERQKADKKRNRTK

SEQ ID NO: 1611 - protein, 252 aa, Lactobacillus acidophilus
  source: /note="strain 30SC"
MSRTPIIAGNWKLHMNPEQTTEFVDAVKDKLPDPSKVESLICAPAVDLDALRKAAKGSNLHIGAENCYFEDEGAYTGETSPKVLKEMGMDYVIIGHSERRGYFHETDEDINKKAKAIFANGLKPIICCGESLETREANKQEDWVVAQIKAALDGLTAEQVSSLVIAYEPIWAIGTGKTASSDQAEEMCKTIRETVKDLYNEETAENVRIQYGGSVKPANVKELMSKPDIDGGLVGGASLKPESYLELVNYQD

SEQ ID NO: 1612 - protein, 283 aa, Lactobacillus acidophilus
  source: /note="strain 30SC"
MSTIYNSVTELIGNTPLLKLNRVVPEDAADVYVKLEFENPAGSTKDRIALAMIEKAERDGNLKPGGTITSLNTGIGLAMVAAAKGYHIIIVMPETMSVECRKLMKGYGAELILTPGSEGMKGSIAKAEELVKEKSYYMPMQFDNPENPNIHELTTGPEIISAMNGIGKSVDAFVAGVGTSGTLSGISRALKKENPNTKVYALEPSESPLLKDGKTGKHGIAAGFIPKNLDKDVYDGIVEVSTDEAMKIACEVAKNEGFLPGILIVTFQLLYLTNKQNITEIIV

SEQ ID NO: 1613 - protein, 305 aa, Lactobacillus acidophilus
  source: /note="strain 30SC"
MAYFDNGNQIFKDARRNHYAVGAYNTNNLEWTRAELRAAEETRTPLLIQVSTGAAKYMGGYKFVKDMVADQMDSMNISVPVILNLDHGDFESAKECIALGYSSVMFDGHKLDTEENLAKTKEIIKLAHERGISVEAEIGKIGENQGADGGELASVEDAKTFVAAGVDKLACGIGNIHGVYPEGWKGLNFDRLKEIAEAVPEEPLVLHGGSGIPEDQVKKAISLGIAKVNINTEFQLAFQKATREYIEAGKDLDKGNKGYDPRKLLLPGTEAITDAMKEMIGWLGTKTIDDELKDASFDRSSLNEE

SEQ ID NO: 1614 - protein, 544 aa, Lactobacillus acidophilus
  source: /note="strain 30SC"
MSKFRKLMAAGVVTLAGAALAACGNNSSSSSAGGGKKTLNWMDKTEIEGMDVAKVTDATSFTQLNNTMEGLYRLGKNSKVENALATKTTTSKDGRTWTFTLRKDDKWSNGDPVTAKDFVYSWRRTVTPSTGSQYSYLFSGIENADAIVAGKKKPNTLGVKAVGDDKLVVTLDKRIPYFKLLMGFPLFFPQSQKAVEQYGKSYGTSSKTTVYNGPFVQKGWTGSNLSWKLVKNKNYWDKKNVKLNTINYSVQKTPSTDYNLYQSGKLDAALLGPQASKELKNQKGYTLRKTASTIYLEMNQKKAPFNNENFRKALSLAINRKELANSVGGAAEPADTLSPENMTEVKGKDYTNLVRGTATKQFNTYNKKQAQAYWKKAQKELGKKSVSFSILTYDDDASKKGGEFLQSSIESALKGVNVRVQSIPKKTALDHAGSGDYDVFLMGWTADFSDPISFLDLNTSKNSQNWEKYSDSTYDKLVAESKVTPSETTRWNDLVKAEQRIISTQGVTPLYHPEEAWMVRSTVKGVVYNGAGAPYNFKEAYIAN

SEQ ID NO: 1615 - protein, 649 aa, Lactobacillus acidophilus
  source: /note="strain 30SC"
MDHRKVAERVIKDVGRDNIIAGAHCATRLRLVLKDDSKVDQKALDNDPDVKGTFKTNGQYQVIIGPGDVNDVYDEFIKITGLKELSTDDLKKVAAEGQKKNPIMDFIKLLSDIFVPIIPALVAGGLLMALNNFLTSPGLFGPKSVVQMAPNIAGMSEMIQVMSAAPFIFMPILVGMSAAKRFGANQFLGATIGMIMTTPGLQGANHFWNIFGLHVAQTNYQYQVIPVLVAVWVLSILEKFFHKHLPSAVDFTFTPLLSIMITGFLTFTIIGPVFKGVSDAITNAIVWLYNTTGAFGMGVFGLTYSAIVTTGLHQSFPAVETQLLAAFAKNPASSGDFIFVTACMANVAQGAATFAIYFLTKNKKMKGLASSSGVSALLGITEPALFGVNLKYKFPFFCALIGSGVAAAFAGFTHVTAAALGSAGFLGFLSIYPKTIPMWIVSVLISFAVAFILTYVYGKGHLKEEVAEQDVPVNDAADYAEENQKAEKLGKEELSLKDEIIVSPVTGTPESLTKVNDQVFSAKLMGDGAAVIPSDGTIYSPVNGTVTIAYETKHAYGIKSDNGAEVLIHIGLDTVNLKGEHFESFVKQGQRVEKGDKLGSVDLDAVKKAGYDTTVMVVITNTANYANVQRITDAGDKHGDKLIAVTAHE

SEQ ID NO: 1616 - protein, 501 aa, Lactobacillus acidophilus
  source: /note="strain 30SC"
MKKNLRIISVAAAALLAVAPVVSTAIPVNADTAVNVGSSTGTGANTTNTNTQAPQNKPYFTYNNEIIGESTQSNPLGNVVRTTVSFKSGDKVSDLISKISKAVQFHKDNYAGGENVTINEQDFINQLKNNGVTTKTINPSKKGEKSYEEIDKVPSTSFNITLSASANNQTATIQIPMVPEGASAPVDTTQNPQINWTKGGQAQSASLNGQVFQVAVGSSFNPLSFTNSNGDTISISAQQSKDNSTYASIEATSNPVNTSEAGRYYNVTLTATGNTGKKTTATYTVLITSSQKQTLYANGASSIPTYSIYGGNVLSNSTTFKDGDQVYVSDKTETIGNVSYSQVSTKSKSDANGSNMWVKTSALVKPAGDTNVKTYPVMIDSRAYDKNGNYLGHMYYAYDNIDVVPTVVTINGKTYYKVANKDEYVRVTNITGNKRTLTHNAYIYWSSYRRTPGTGKMYKGQTVTTYGPAMRFKNGKKYYRIEGCRNNNKRYIKAANLSAAQ

SEQ ID NO: 1617 - protein, 180 aa, Lactobacillus acidophilus
  source: /note="strain 30SC"
MLKYNVRGENIEVTDALRSYVEKRLNKLEKYFELNQDVLAHVNLRVYRDHSAKVEVTIPLPYLVLRAEETTDDMYRSIDFVSEKLERQIRKYKTRVNRKSREKGLQDFFVEEPQEEKKPSEFDIVRNKRVSLKPMDPEEAILQMDMLEHDFFVFEDAETNGTSVVYRRNDGRYGLIETNE

SEQ ID NO: 1618 - protein, 203 aa, Lactobacillus acidophilus
  source: /note="strain 30SC"
MSRYTGPSWKRSRRLGISLSGTGKEIARRNYAPGQHGPNSRGRLSEYGQQLHEKQKLRWMYGLNERQFRTLFARAGKIREGQHGVNFMILLERRLDNIVYRLGLATTREQARQLVNHGHITVDGKRVDIPSYEVSVGQTIGLKEKSKNLQQVKDALDAVTARPSFVSFDDNKMEGSLVRLPERDEMEPEIDESLVVEYYNKLL

SEQ ID NO: 1619 - protein, 403 aa, Lactobacillus acidophilus
  source: /note="strain 30SC"
MAKLIVDDLDVNGKKVLMRVDFNVPIKDGVIGDDNRIVAALPTIKYIIEHGGKAILLSHLGRVKSDADKKELSLKPVAERLSELLKKPVTFVPSNEGKEVEDAINAMKDGDVVVLENTRFQDIDNDFGKRESGNDPKLGEYWASLGDMFVNDAFGTAHRSHASNVGIATAMKKDGKPVAAGFLMEKEIKFLGNAVENPVHPFVTILGGAKVSDKIAVIKNLIPKSDHILIGGGMAYTFLAAQGHKIGKSLFEKDRVELAKELLKEADGKIVLPVDNVAATEFSNDASREVVGDDIPDNMMGLDIGPKTVEKFTEILKDAKTVVWNGPMGAFEMPNFAKGTYAIADALANLTDATTIIGGGDSTSAVKKSGVADKITHISTGGGASLQYLEGNELPGIACISDK

SEQ ID NO: 1620 - protein, 445 aa, Lactobacillus acidophilus
  source: /note="strain 30SC"
MSLIKFDSSKLTPFVHENELSEMQAMVNAANTELREGTGAGNDFRGWLNLPVDYDKDEFARIKKAAKKIQNDSDVLICIGIGGSYLGAQAAIEFLNSNFYGKVDSDMPTVVFCGNSLSGSYLYDLIEWLGDKDFSVNVISKSGTTTEPSVAFRIFKDKLIKKYGKEEAAKRIYATTDRQKGALKTEADAEGYEEFVVPDDVGGRYSVLSAVGLLPIAASGADIDELMKGAADARADYTDTDLSKNSPYQYAALRNILYRKGYTTEIVENYEPSLRMFGEWCKQLMGESEGKDQKGIYPSSANFTTDLHSLGQYIQEGLRNLFETVIRVENPRHDVKIPGDEKNLDQLNFLEGKSLNYVNDRAYEGVVLAHTDGGVPVMTVNIPDQSAHTLGYMIYFFELAIAISGYLNGINPFNQPGVEAYKRNMFGLLNKPGYENLHDDLAKRL

SEQ ID NO: 1621 - protein, 91 aa, Lactobacillus acidophilus; identical to SEQ ID NO: 590
  source: /note="strain 30SC"

SEQ ID NO: 1622 - protein, 588 aa, Lactobacillus acidophilus
  source: /note="strain 30SC"
MNPEKVLKQTFGYDSFRPGQKKVIDLVLNKQNVLAVMPTGAGKSLCYQVPALMNAGVTLVISPLISLMKDQIDTLKQNGINAAALNSATPQEEVNPILRQAYEGKIKLIYITPERLAIDYFRYQLNFLDIDLVAVDEAHCISQWGHDFRPAYRQLLDGINSLKSRPNILALTATATPAVQDDICEQLNIPKQNMIITSFARPNLSFKVVNSPQNTPLYIAQYIKMHPDEAGIIYTNTRKKVESLTDYLAKKGISVGAYHGGMETKERDEVQEAFQFDQVQVIVATNAFGMGIDKSNVRFVIHASSARNIESYYQEAGRAGRDGEESEAIMIYHPGDLRQYRFFIDESTADEKYRELQYQKLQAITDYANTGECLQQFIVRYFGQDCEPCGKCSNCLNQDELTDITADAQKVISMVYELDGRFGKNVVAQCLVGSNNQKMKEMNASQYDYFGSLKMNQKETISLIDYLIASRYLEIEGTKYPLVHVTNRGWDVLDGKITVKRRIAKVQKKKQIFAQDENPDLYEALRKKRMELARKQRVPAFMIFSDRSLHDMAKIKPQNEAEFLEVSGVGQAKMQKYGATMIQVIKSF

SEQ ID NO: 1623 - protein, 115 aa, Lactobacillus acidophilus
  source: /note="strain 30SC"
MDPLIQELTKEQIRDDIPAFRAGDTVTVHVRVVEGTHERIQLFEGVVIKKKGTGIGATYTVRKIASGVGVERTFPVNDPRVAKVEVKRHGRVRRAKLYYLRERHGKSARIAEARR

SEQ ID NO: 1624 - protein, 590 aa, Lactobacillus acidophilus
  source: /note="strain 30SC"
MKKAKVFAGITLLSGVALTLAACGKPSNQNANEASTAAKFSSVVPKKATKNGGTVKVAVETDTPFTGIFNDELSTSATDTEVMQYGAESLFSTDDHYVFTNKGAATIKIDQKAKTATINIKKGVKWSDGKQVTAKDYEYAYEIIANKDSKSQRYTASLADLVGLKEYHEGKASTISGLEMPDGENGRKVVLHFKTMKPGMNTSGNGYIWEAAAPYHYLKDVKFSDLMSSDKIRKKPLFFGPYKLQKLVRGQSATWVPNKYYYKGKPKLSKITATVINPNSVAQSIKSNKFDVIQVINSQWPNVKNTKGVNFIATVPLSYSYLGFKVGKWDAKKGENVMNPKSKMNNKALRQAIGYGMNVNQVAKRYSYGLSFRIPTLIPKQFGDYFDKDVKGYSYNIKKGNEILDKAGYKKKGTYRVQPNGKPLTIHLAAMSGNANQEPIIQNYIQQWKKEGLNVKLTGGRLIEFNSFYDKVQNDDPSVDMFMGAWSLSSEPSPNDLYSKTAPMNYSRFVTKKNTQLLDEMDSQKAFNHQYRIDKFHEWQKYMDDEAYVLPVSNSYTITAVNKKLTGYSLKPSASMGNGFPNWYNVAYAK

SEQ ID NO: 1625 - protein, 301 aa, Lactobacillus acidophilus; identical to SEQ ID NO: 602
  source: /note="strain 30SC"

SEQ ID NO: 1626 - protein, 667 aa, Lactobacillus acidophilus
  source: /note="strain 30SC"
MRIKDILSPESMIMDLKAKNKEDAIKEMADLEVATDIVNDEDAFIKSIWDRENESTTGIGGGIAMPHARNKSINKARVLFAKSKDGIDYNSLDGQPVHLFFMITAPAGADNTHLQALAKLSGLLIDPDLVEKLKATKTPEEVIDLFEKAEAKKDEEDKKAAEAKKAKEAAKAEGKNDDDDNKPLIVGVTACINGIAHTYMAQEALIKEGKKRGIEVRIETNGSEGVKDKLTPDEIKRAKGVIIASDKKVDMPRFDGKPLVNRPVVDGINKPGELIDDIMDGKADVYHASASDKSEESSSSTEKPGVWAGIYKNLMNGISHMLPFVIGGGILMAISFIVENYGGGAKTPAFIFLNNAGNLAFAFMVPVLSAYIAESIGDLPALMPGFVGGYMASIANGQFQVNVQAHATSPAGFLGGIAAGFIAGYLMVGLKKLFANLPHSVEGMKPMLFYPILGLLFIAAIMFYIINPIFSGINFAITHFLNSMGTGNLVLLTTILAGMMSIDMGGPFNKAAYVFASGAFANDPHSTTAAILMAAVMVGGMVPPFATAIGTTFFKNKYTQEERRAGVSNWVLGFSFITEGAIPFAAADPGRVIPSCIIGSAVGGALVGLWHVGVPAPHGGLWVSPLAGNIGGPSHILFYFLATIIGSIVAGLIMSFWKKNIKEDPNE

SEQ ID NO: 1627 - protein, 431 aa, Lactobacillus acidophilus
  source: /note="strain 30SC"
MINRYTRPEMGKIWTDENRYAAWLEVEIAATRAWAEQGEVPKEDAEKIAKNASFTAERVAELEQVTHHDVVAFTRTVSESLGPEKKWVHFGLTSTDVVDTAQGLLLKQADNIIRKDLHELKETIAEKARKYKYTVEMGRTHGVQAEPTTFGLKLARWYAEINRDIERFEHAAKGVESGKISGAVGTFANVPPEIETSVMKQLGLTQQPITSQVLPRDLHAEYIAMLALIATSIENWATEIRGLQRSEIHEVEEHFRAGQKGSSAMPHKRNPIGSENLCGMARVLRGHVVTAYEDVALWHERDISHSSAERVILPDTTIGIDYMLHRFNRILSNLDVFPETMLKNMDRTYGLIYSQRVLLKLIDEAGLSREKAYDMVQKLTAKSWNEQKQFKPLVENSEIMNYLSKEDVDDAFDYHYHLRHVDEIFKKCGLD

SEQ ID NO: 1628 - protein, 102 aa, Lactobacillus acidophilus
  source: /note="strain 30SC"
MASQTIRIRLKSYEHGILDESAAKIVATAKRTGAEISGPVPLPTERTLFTVLRSPHMNKDSREQFEMRTHKRLIDILNPTPKTVDSLMKLDLPSGVDIEIKL

SEQ ID NO: 1629 - protein, 88 aa, Lactobacillus acidophilus; identical to SEQ ID NO: 640
  source: /note="strain 30SC"

SEQ ID NO: 1630 - protein, 122 aa, Lactobacillus acidophilus
  source: /note="strain 30SC"
MIQNESRLKVADNSGARELLVIRVLGGSKRKTGNIGDIVVCTVKQATPGGVVKKGDVVKAVIVRTKSGARREDGSYIKFDENAGVIINADKSPRGTRIFGPVARELREHDFMKIVSLAPEVL

SEQ ID NO: 1631 - protein, 132 aa, Lactobacillus acidophilus; identical to SEQ ID NO: 626
  source: /note="strain 30SC"

SEQ ID NO: 1632 - protein, 116 aa, Lactobacillus acidophilus; identical to SEQ ID NO: 631
  source: /note="strain 30SC"

SEQ ID NO: 1633 - protein, 127 aa, Lactobacillus acidophilus
  source: /note="strain 30SC"
MAYRKLGRDSAHRKAMLREMTTQLIMNERIVTTETRAKEVRKTAEKMITLGKRGDLASRRKAAAFVRDEVADIHEEKDTVVVKSALQKLFSDVAPRYKDRNGGYTRILKLAVPRKGDAAPMVILELV

SEQ ID NO: 1634 - protein, 338 aa, Lactobacillus acidophilus
  source: /note="strain 30SC"
MSEKKDVRILAYESSCDETSTAVIKNGRDIKSLIVATQIKSHQRFGGVVPEVASRHHIEVISQITKEALSEANCTWKDIDAIAVTYGPGLVGALLIGVSAAKAASMATGISLIGVDHIMGHIMAAQLKDEIEYPALALQVSGGHTEIVLLKDPVHFEIIGDTRDDAAGEAYDKIGRVLGVNYPAGKTIDAWAHEGKDTFNFPRAMMEDDDYDFSFSGLKSAFINTCHHADQIHEKLNKYDLAASFQAAVIDVLAHKTIRAIKQYKPKTFIMGGGVAANHGLRDRMSAEIAKLPKQDQPKVILPDIKLCGDNAAMIGAAAYNLQYLEFIWFTKRFTKIG

SEQ ID NO: 1635 - protein, 570 aa, Lactobacillus acidophilus
  source: /note="strain 30SC"
MVDNTSLTGAALLIDALQANGLNNMYGVVGIPVTDFARLAELKGMKFYGFRREDSAVDAAAAAGFITGKPGVALTVSAPGFLNGLTALAQATKNCFPLIMISGSSDRHIIDLDRGDYEGLDQYNVAKPFCKAAYRVDRAEDMGLAVARAVRTAVSGRPGGVYLDLPAATVSDTVAQKSDANIYKVVDPAPKQLPSDEAINRAVELLNNAKHPVLLLGKGAAYAQAEDEIRELVAKTNIPFLPMSMAKGVVPDDSPASAASARSFTLGQADVVLLVGARLNWMLSNGGSPLFSPDAKFIQVDIDATEFDSNRKIDAPLQGDIKSVMQKFNSAVIDAGVKAPQDWLDQIKTESEKNNTKFAKRISASEAKPTLGFYSAIEPINDLLQKHPDTYIVSEGANTLDIGRNLISMQKPRHRLDTGTWGVMGVGMGYAIATAVETGKPVIALEGDSAFGFDGMEMETICRYHLPVIVVVVNNGGIYNGDVNVVPDQPGPTVLDHDAHYGDIAKAFGGDSYRVNNYTEMKDALEKAYESGNPTIIDAQIPASMGKESGHIGNLNPKLDLSSLEEKENK

SEQ ID NO: 1636 - protein, 543 aa, Lactobacillus acidophilus
  source: /note="strain 30SC"
MAKDIKFSENARRSLLKGVDKLADTVKTTIGPKGRNVVLEQSYGNPDITNDGVTIAKSIELKDHYENMGAKLVAEAAQKTNDIAGDGTTTATVLTQAIAREGMKNVTAGANPVGIRRGIEKATQAAVDELHKISHKVESKDQIANVAAVSSASKEVGDLIADAMEKVGHDGVITIEDSRGINTELSVVEGMQFDRGYLSQYMVTDNDKMEADLDNPYILITDKKISNIQDILPLLQEIVQQGKALLIIADDVSGEALPTLVLNKIRGTFNVVAVKAPGFGDRRKAQLQDIAALTGGTVITDDLGLELKDAKIDQLGQARRVTVTKDSTTIVDGAGSKDAIQEREDSIRKQIEESTSDFDKKKLQERLAKLTGGVAVIHVGAATETELKERRYRIEDALNSTRAAVDEGYVAGGGTALVDVEKAIKDLKGDTPDEQTGINIVLRALSAPVRQIAENAGKDGAVVLNKLENQENEVGYNAATDKWENMVDAGIIDPTKVTRTALQNAASIAALLLTTEAVVAEIPEEKPAAPQGGAGAGAPGMGM

SEQ ID NO: 1637 - protein, 124 aa, Lactobacillus acidophilus; identical to SEQ ID NO: 562
  source: /note="strain 30SC"

SEQ ID NO: 1638 - protein, 1939 aa, Gallus gallus
MASPDAEMAAFGEAAPYLRKSEKERIEAQNKPFDAKSSVFVVHPKESFVKGTIQSKEGGKVTVKTEGGETLTVKEDQVFSMNPPKYDKIEDMAMMTHLHEPAVLYNLKERYAAWMIYTYSGLFCVTVNPYKWLPVYNPEVVLAYRGKKRQEAPPHIFSISDNAYQFMLTDRENQSILITGESGAGKTVNTKRVIQYFATIAASGEKKKEEQSGKMQGTLEDQIISANPLLEAFGNAKTVRNDNSSRFGKFIRIHFGATGKLASADIETYLLEKSRVTFQLPAERSYHIFYQIMSNKKPELIDMLLITTNPYDYHYVSQGEITVPSIDDQEELMATDSAIDILGFSADEKTAIYKLTGAVMHYGNLKFKQKQREEQAEPDGTEVADKAAYLMGLNSAELLKALCYPRVKVGNEFVTKGQTVSQVHNSVGALAKAVYEKMFLWMVIRINQQLDTKQPRQYFIGVLDIAGFEIFDFNSFEQLCINFTNEKLQQFFNHHMFVLEQEEYKKEGIEWEFIDFGMDLAACIELIEKPMGIFSILEEECMFPKATDTSFKNKLYDQHLGKSNNFQKPKPAKGKAEAHFSLVHYAGTVDYNISGWLEKNKDPLNETVIGLYQKSSVKTLALLFATYGGEAEGGGGKKGGKKKGSSFQTVSALFRENLNKLMANLRSTHPHFVRCIIPNETKTPGAMEHELVLHQLRCNGVLEGIRICRKGFPSRVLYADFKQRYRVLNASAIPEGQFMDSKKASEKLLGSIDVDHTQYRFGHTKVFFKAGLLGLLEEMRDDKLAEIITRTQARCRGFLMRVEYRRMVERRESIFCIQYNVRSFMNVKHWPWMKLFFKIKPLLKSAESEKEMANMKEEFEKTKEELAKSEAKRKELEEKMVVLLQEKNDLQLQVQAEADSLADAEERCDQLIKTKIQLEAKIKEVTERAEDEEEINAELTAKKRKLEDECSELKKDIDDLELTLAKVEKEKHATENKVKNLTEEMAVLDETIAKLTKEKKALQEAHQQTLDDLQVEEDKVNTLTKAKTKLEQQVDDLEGSLEQEKKLRMDLERAKRKLEGDLKLAHDSIMDLENDKQQLDEKLKKKDFEISQIQSKIEDEQALGMQLQKKIKELQARIEELEEEIEAERTSRAKAEKHRADLSRELEEISERLEEAGGATAAQIEMNKKREAEFQKMRRDLEEATLQHEATAAALRKKHADSTAELGEQIDNLQRVKQKLEKEKSELKMEIDDLASNMESVSKAKANLEKMCRTLEDQLSEIKTKEEQNQRMINDLNTQRARLQTETGEYSRQAEEKDALISQLSRGKQGFTQQIEELKRHLEEEIKAKNALAHALQSARHDCELLREQYEEEQEAKGELQRALSKANSEVAQWRTKYETDAIQRTEELEEAKKKLAQRLQDAEEHVEAVNAKCASLEKTKQRLQNEVEDLMVDVERSNAACAALDKKQKNFDKILAEWKQKYEETQTELEASQKESRSLSTELFKMKNAYEESLDHLETLKRENKNLQQEIADLTEQIAEGGKAVHELEKVKKHVEQEKSELQASLEEAEASLEHEEGKILRLQLELNQIKSEIDRKIAEKDEEIDQLKRNHLRIVESMQSTLDAEIRSRNEALRLKKKMEGDLNEMEIQLSHANRMAAEAQKNLRNTQGTLKDTQIHLDDALRTQEDLKEQVAMVERRANLLQAEVEELRGALEQTERSRKVAEQELLDATERVQLLHTQNTSLINTKKKLETDIVQIQSEMEDTIQEARNAEEKAKKAITDAAMMAEELKKEQDTSAHLERMKKNMDQTVKDLHVRLDEAEQLALKGGKKQLQKLEARVRELEGEVDSEQKRSAEAVKGVRKYERRVKELTYQCEEDRKNILRLQDLVDKLQMKVKSYKRQAEEAEELSNVNLSKFRKIQHELEEAEERADIAESQVNKLRVKSREIHGKKIEEEE

SEQ ID NO: 1639 - protein, 1928 aa, Gallus gallus
AMSSDSEMAIFGEAAPYLRKSEKERIEAQNKPFDAKSSVFVVHPKESFVKGTIQSKETGKVTVKTEGGETLTVKEDQVFSMNPPKYDKIEDMAMMTHLHEPAVLYNLKERYAAWMIYTYSGLFCVTVNPYKWLPVYNPEVVLAYRGKKRQEAPPHIFSISDNAYQFMLTDRENQSILITGESGAGKTVNTKRVIQYFATIAASGEKKKEEQPGKMQGTLEDQIISANPLLEAFGNAKTVRNDNSSRFGKFIRIHFGATGKLASADIETYLLEKSRVTFQLKAERSYHIFYQIMSNKKPELIDMLLITTNPYDYQFVSQGEITVPSINDQEELMATDSAIDILGFTPDEKTAIYKLTGAVMHYGNLKFKQKQREEQAEPDGTEVADKAAYLMGLNSADLLKALCYPRVKVGNEYVTKGQTVQQVHNAVGALAKAVYEKMFLWMVVRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYDQHLGKSNNFQKPKPGKGKAEAHFSLVHYAGTVDYNISGWLEKNKDPLNETVIGLYQKSSVKTLALLFASAGGELSEASGGGGKKGGKKKGSSFQTVSALFRENLNKLMTNLRSTHPHFVRCIIPNETKTPGKMLQQRYRICRKGFPSRVLYADFKQRYKVLNASAIPEGQFIDSKKASEKLLGSIDVDHTQYKFGHTKVFFKAGLLGLLEEMRDEKLAQLITRTQARCRGFLMRVEYQRMVERRESIFCIQYNVRSFMNVKHWPWMKLFFKIKPLLKSAESEKEMANMKEEFEKTKEELAKSEAKRKELEEKMVSLLQEKNDLQLQVQAEADSLADAEERCDQLIKTKIQLEAKIKEVTERAEDEEEINAELTAKKRKLEDECSELKKDIDDLELTLAKVEKEKHATENKVKNLTEEMAALDENIAKLTKEKKALQEAHQQTLDDLQAEEDKVNTLTKAKTKLEQQVDDLEGSLEQEKKLRMDLERAKRKLEGDLKLAHDSIMDLENDKQQLDEKLKKKDFEISQIQSKIEDEQALGMQLQKKIKELQARIEELEEEIEAERTSRAKAEKHRADLSRELEEISERLEEAGGATAAQIDMNKKREAEFQKMRRDLEEATLQHEATAAALRKKHADSTAELGEQIDNLQRVKQKLEKEKSELKMEIDDLASNMESVSKAKASLEKTCRALEDQLSEIKTKEEEHQRMINDLNAQRARLQTESGEYSRQVEEKDALISQLSRGKQAFTQQIEELKRHLEEEIKAKSALAHALQSARHDCDLLREQYEEEQEAKGELQRALSKANSEVAQWRTKYETDAIQRTEELEEAKKKLAQRLQDAEEHVEAVNAKCASLEKTKQRLQNEVEDLMIDVERANAACAALDKKQKNFDKILSEWKQKYEETQTELEASQKESRSLSTELFKMKNAYEESLDHLETLKRENKNLQQEISDLTEQIAEGGKAIHELEKVKKQIEQEKSEIQAALEEAEASLEHEEGKILRLQLELNQVKSEIDRKIAEKDEEIDQLKRNHLRIVESMQSTLDAEIRSRNEALRLKKKMEGDLNEMEIQLSHANRVAAEAQKNLRNTQGVLKDTQIHLDDALRTQEDLKEQVAMVERRANLLQAEIEELRAALEQTERSRKVAEQELMDASERVQLLHTQNTSLINTKKKLETDISQIQSEMEDTIQEARNAEEKAKKAITDAAMMAEELKKEQDTSAHLERMKKNLDQTVKDLQLRLDEAEQLALKGGKKQIQKLEARVRELEGEVDSEQKRSAEAVKGVRKYERRVKELTYQSEEDRKNILRLQDLVDKLQMKVKSYKRQAEEAEELSNVNLSKFRKIQHELEEAEERADIAESQVNKLRVKSREFHSKKIEEE

SEQ ID NO: 1640 - protein, 1939 aa, Gallus gallus
MSSDAEMAIFGEAAPYLRKSEKERIEAQNKPFDAKTSVFVVHAKESYVKSTIQSKESGKVTVKTESGETLTVKEDQIFSMNPPKYDKIEDMAMMTHLHEPAVLYNLKERYAAWMIYTYSGLFCVTVNPYKWLPVYNPEVVLAYRGKKRQEAPPHIFSISDNAYQFMLTDRENQSILITGESGAGKTVNTKRVIQYFATIAASGDKKKEEQPAGKMQGTLEDQIISANPLLEAFGNAKTVRNDNSSRFGKFIRIHFGATGKLASADIETYLLEKSRVTFQLKAERSYHIFYQIMSNKKPELIEMLLITTNPYDYHYVSQGEITVPSINDQEELMATDSAIDILGFTPDEKTAIYKLTGAVMHYGNLKFKQKQREEQAEPDGTEVADKAAYLMGLNSADLLKALCYPRVKVGNEFVTKGQTVQQVYNSVGALAKAVFEKMFLWMVVRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYDQHLGKSNNFQKPKPGKGKAEAHFSLVHYAGTVDYNISGWLDKNKDPLNETVVGLYQKSSLKTLALLFASAGGEAESGGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDVDHTQYKFGHTKVFFKAGLLGLLEEMRDEKLAQLITRTQARCRGFLMRVEYRRMVERRESIFCIQYNIRSFMNVKHWPWMKLFFKIKPLLKSAESEKEMANMKGEFEKTKEELAKSEAKRKELEEKMVSLLQEKNDLQLQVQAEADALADAEERCDQLIKTKIQLEAKIKEVTERAEDEEEINAELTAKKRKLEDECSELKKDIDDLELTLAKVEKEKHATENKVKNLTEEMAALDENIAKLTKEKKALQEAHQQTLDDLQAEEDKVNTLTKAKTKLEQQVDDLEGSLEQEKKLRMDLERAKRKLEGDLKLAHDSIMDLENDKQQLDEKLKKKDFEISQIQSKIEDEQALGMQLQKKIKELQARTEELEEEIEAERTSRAKAEKHRADLSRELEEISERLEEAGGATAAQIDMNKKREAEFQKMRRDLEEATLQHEATAAALRKKHADSTAELGEQIDNLQRVKQKLEKEKSELKMEIDDLASNMESVSKAKASLEKTCRALEDQLSEIKTKEEEHQRMINDVNAQRARLQTESGEYSRQVEEKDALISQLSRGKQAFTQQIEELKRHLEEEIKAKNALAHGLQSARHDCDLLREQYEEEQEAKGELQRALSKANSEVAQWRTKYETDAIQRTEELEEAKKKLAQRLQDAEEHVEAVNSKCASLEKTKQRLQNEVEDLMIDVERANSACAALDKKQKNFDKILSEWKQKYEETQAELEASQKESRSLSTELFKMKNAYEESLDHLETLKRENKNLQQEISDLTEQIAEGGKAIHELEKVKKQIEQEKSELQASLEEAEASLEHEEGKILRLQLELNQVKSEIDRKIAEKDEEIDQLKRNHLRIVESMQSTLDAEVRSRNEALRLKKKMEGDLNEMEIQLNHANRMAAEAQRNLRNTQGVLKDTQIHLDDALRSQEDLKEQVAMVERRANLLQAETEELRAALEQTERSRKVAEQELLDASERVQLLHTQNTSLINTKKKLESDISQIQSEMEDTIQEARNAEEKAKKAITDAAMMAEELKKEQDTSAHLERMKKNLDQTVKDLQHRLDEAEQLALKGGKKQIQKLEARVRELEGEVDAEQKRSAEAVKGVRKYERRVKELTYQSEEDRKNVLRLQDLVDKLQMKVKSYKRQAEEAEELSNVNLSKFRKIQHELEEAEERADIAESQVNKLRVKSREFHKKIEEEE

SEQ ID NO: 1641 - protein, 1942 aa, Gallus gallus
MASSDAEMAVFGEAAPYLRKSEKERIEAQNKPFDAKSSVFVAHPKESFVKGTIQSRETGKVTVKTEGGETLTVKEDQVFSMNPPKYDKIEDMAMMTHLHEPAVLYNLKERYAAWMIYTYSGLFCVTVNPYKWLPVYNPEVVLAYRGKKRQEAPPHIFSISDNAYQFMLTDRENQSILITGESGAGKTVNTKRVIQYFATIAASGEKKKEEQSGKMQGTLEDQIISANPLLEAFGNAKTVRNDNSSRFGKFIRIHFGATGKLASADIETYLLEKSRVTFQLKAERSYHIFYQVTSNKKPELIEMLLITTNPYDYPFVSQGEITVPSIDDKEELMATDSAIDILGFTADEKTAIYKLTGAVMHYGNLKFKQKQREEQAEPDGTEVADKAAYLMGLNSADMLKALCYPRVKVGNEYVTKGQTVQQVHNAVGALAKAVYERMFLWMVVRINQQLDTKQPRQYFIGVLDIAGFEIFDFNSFEQLCINFTNEKLQQFFNHHMFVLEQEEYKKEGIEWTFIDFGMDLAACIELIEKPMGIFSILEEECMFPKATDTSFKNKLYDQHLGKSSNFQKPKPTKGKVEAHFSLIHYAGTVDYNITGWLEKNKDPLNETVIGLYQKSSLKTLALLFANYGGAEAEASAGAGKKGGKKKGSSFQTVSALFRENLNKLMTNLRSTHPHFVRCIIPNETKTPGAMEHELVLHQLRCNGVLEGIRICRKGFPNRVLYADFKQRYKVLNASAIPEGQFIDSKKACEKLLGSIDIDHTQYKFGHTKVFFKAGLVGLLEEMRDEKLAQLITRTQARCRGFLMRVEYQKMVERRESVFCIQYNIRAFMNVKHWPWMKLFFKIKPLLKSAESEKEMANMKQEFEKTKEELAKSEAKRKELEEKMVKLVQEKNDLQLQVQAEADALADAEERCDQLIKTKIQLEAKVKEVTERAEDEEEINAELTAKKRKLEDECSELKKDIDDLELTLAKVEKEKHATENKVKNLTEEMAALDETIVKLTKEKKALQEAHQQTLDDLQAEEDKVNTLTKAKTKLEQQVDDLEGSLEQEKKLRMDLERAKRKLEGDLKLAHDSIMDLENDKQQLDEKLKKKDFEISQIQSKIEDEQLLGMQLQKKIKELQARIEELEEEIEAERTSRAKAEKHRADLSRELEEISGRLEEAGGATAAQIEMNKKREAEFQKMRRDLEEATLQHEATAAALRKKHADSTAELGEQIDNLQRVKQKLEKEKSELKMEIDDLASNMESVSKAKANLEKMCRTLEDQLSEFKTKDEQNQRMISDLSAQRARLQTESGEYARQADEKDGLISQLSRGKQAFTQQIEELKRQLEEEIKAKNALAHSLQSARHDCDLLREQYEEELEAKGELQRALSKANSEVAQWRTKYETDAIQRTEELEEAKKKLAQRLQDAEEHVEAVNAKCASLEKTKQRLQNEVEDLMIDVERANAACAALDKKQKNFDKILAEWKQKYEETQAELEASQKESRSLSTELFKMKNAYEESLDHLETLKRENKNLQQEISDLTEQIAEGGKAIHELEKVKKQIEQEKSEIQAALEEAEASLEHEEGKILRLQLELNQVKSEIDRKIAEKDEEIDQLKRNHLRIVESLQSSLDAEIRSRNEALRLKKKMEGDLNEMEIQLSHANRVAAEAQKNLRNTQAVLKDTQIHLDDALRTQEDLKEQVAMVERRANLLQAEIEELRAALEQTERSRKVAEQELMDASERVQLLHTQNTSLINTKKKLETDIAQIQSEMEDTIQEARNAEEKAKKAITDAAMMAEELKKEQDTSAHLERMKKNLDQTVKDLQHRLDEAEQLALKGGKKQIQKLEARVRELEGEVDAEQKRSAEAVKGVRKYERRVKELTYQSEEDRKNILRLQDLVDKLQMKVKSYKRQAEEAEELSNVNLSKFRKIQHELEEAEERADIAESQVNKLRVKSREFHSKKIEEEE

SEQ ID NO: 1642 - protein, 6591 aa, Gallus gallus
KMEEEEYEEVVEYYIEETIVEEGEPYEVVTEITDSTSTEFTGPTTITRTIEYEKTSGEGAATPVRKKTIRTKMDTSKFLTPYLQHSNKMKDLFSENKYKEKFNKERGKPYASTIDTPEIRRIKKVQEQLSEVKYRMAGEAARTICHVDEKAWDIEHAKKVSQQVSKVLYKQNWEENKDKYLLPPDAPELVNAIKNTAMFSKKLYTEDWEGDKTLFYPYNDSPELRRVAQAQKALSDIVYKKGHDERKSKYTSLPDPPDVEQAKKVTRQLSDIIYHDDYKNKIKGKWSQTPCYDVVIAKMNAENLSMKKYQEDFENVKDQIYFMQTETPEYEANKRVSDNVSKIKYRADYEKNKAIADYNVLPATENPLLRQLKTAGDVLSDKLYKEAYERSKGTSMNYCETPKFQTDNALKNFSDVKYKDAYQKNILGHYLGSFEDPHQIHCMKVEAMKSDKNYKADYEEEKTKCYFPQTITQEYEAIKKLEQCKDHTYKKHPDQIKFTPVTDSPVQKQAEINSKQLSDKLYRSSGEEVKHKYTLPPDVPQFIQARYNAANVSDAYYKQDYHDLIAKGNNVSLDAIPITRAKASRNIASDVSIYSRYTYFRHLVKMSTTSGCMVDSKYSISLTRVTNQSVGLYKTSFILIMFALDKQMLLYCFLNHSSRLINELEGHIAQIVEVDYDSVISDKLYSFCYSFQVREMDCLNCFNIFHTPLSTVILRKLWLMNHCYVYNLLCIVLDGGKRKADIANVPEQVAAFLSSESHNRFSSPYKYKEAYEKAKGQQVGFKSLQDDPKLVHYMHVAKIQSDREYKKDYEKSKTNYHTPPDTFSIQAAKKSQDVASTAHYKNLIHHYTYLPDAMDVELAKNMMQIQSDNVYKQDYNSWFKGIGWSPLGSLDVEKAKKAGDALNEKKYRQHPDTIKFTSVPDSMTMVLAQHNTKQLSDVAYKQEGEKVKHKYKLDPDVPQFIQARVNAFNLSDANYKADWKKTIAKGYDLKPDAIPIIAAKASRNIASDYKYKESYEKDKGRQVGYRSLQDDPKLVHYMHVAKMQSDREYKKDYEVTKTKYHTPLDMFSVTAAKKAQEAVTNTGYKQLIHHYTLLPDSVNLELSRNMMQLQSDNMYKADFNNWLRGVGWLPIQSLEVEKAKKASEILSEKKYRQHPDKLKYSIPLDAMEQVLAKQNAKTMNKRLYTDKWNKEKTSIHVMPDTPEILQSRVNQITMSNKLYKAGWEEDKKKGYDMRPDAIPIKAAKTSQDIASDYKYKLAHEKAKGKHIGFRSLEDDPKLVHFMQVAKMQSDREYKKDYEKAKTNFHTPVDMLSVVAAKKAQEVATNANYKNLIHVYNVLPDAMSLELAKNMMQIQSNNQYRAEYDESMKGVGWMPLGSLEAEKNKKAMEILSEKKYRQHPDKLKYSVPVDSMNMALALHNAKIMDEHQYKQAWEEDKKKVHMTPDIPQFALAKANAFNISDKMYRHSFEEARKKGYDLRSDAIPIKAAKASRDIASDYKYKLGYEQDKGKLVGFRSLQDDPKLVHYMQVAKMQSDREYKKAYETSKTHYQTPSDALSIMAAKEAQDRVTNANYKRLIHHYMLLPDAMSFELYRNMNQIQSNNEYKQDYNEWFKGIGWSPAGSLDVEKSKKATEIASDQKYRQHPSIFPFTKQIDAMDMVLAKHNADIMNKHAYTQAWEKDKTQVHVMPDTPDILQAKQNKANYSQKQYKLDWQEMIKKGYDLTPEAISVKAAKASRDIASDYKYKEGYRKQQGHHIGFRSLQDDPKMMWSMQVAKMQSEREYKKDFEKWKTKFNMPVDMLGFLLAKKCQELVSDIDYKHMLHRWTCLPDQNDVTQAKRVYELQSDNLYKSDLQWLKGIGWSPLGSLESEKNKKASEILSEKKYRQHPDTIKFTSIPDAMNIILAKSNAKNRSDILYREAWDKDKTQVHIMPDTPEILLAKSNLINTSDKHYKLGYEELRRKGYDLPPDAIPLKSAKASRDIASEYQYKTAYRKQLGHHVGARNIEDDPKMMWSMHVAKIQSDREYKKAFEKTKTHFSSPVDMLGIVLAKKCQELVSDVDYKHLLHRWTCLPDQNDVVQARKVYDLQSDNVYKSDLQWLRGIGWSPLGSLDEEKNKRASMILSDKKYRQHPDTIKFTSLPDSMPMVLAKHNSEIMNHRSYIAAWEKDKTSIHIMPDTPGILLAQQNKVNYSEKMYRLAMEEDKKKGYDLRADAIPIKAAKASRDIASDYKYKEGYRKQLGHHIGARNIEDDPKMMWSMHVAKVQSDREYKKAFEKTKTHFSSPVDMLGIVLAKKCQELVSDVDYKHLLHRWTCLPDQNDVVQARKVYDLQSDNVYKSDLQWLRGIGWSPLGSLDEEKNKRASMILSDKKYRQHPDTIKFTSLPDSMPMVLAKHNSEIMNHRSYIAAWEKDKTSIHIMPDTPGILLAQQNKVNYSEKMYRLAMEEDKKKGYDLRADAIPIKAAKASRDIASDYKYKEGYRKQLGHHIGARNIEDDPKMMWSMHVAKIQSDREYKKAFEKTKTHFSSPVDMLGIVLAKKCQELVSDVDYRHYLHQWICLPDQNDVIHARKAYDLQSDNFYKSDLEWMRGIGWVPIGSLDIEKAKRAGQILSDKVYRQPPDTIKFTSVTDSLEMTLAKHNAEMMNKRLYTEAWDKDKTQIHIMPDTPEITLAKQNMHNYSEKLYKQAMEEAKKKGYDLRSDAIPIQAAKASRQIASDYKYKEGYRKQLGHHIGARNIEDDPKMMWSMHVAKIQSDREYKKAFEKTKTHFSSPVDMLGIVLAKKCQELVSDVDYRHYLHQWICLPDQNDVIHARKAYDLQSDNFYKSDLEWMRGIGWVPIGSLDVEKAKRAGQILSDKVYRQPPDTIKFTSVTDSLEMTLAKHNAETMNKRLYTEAWNKDKTTIHVMPDTPEILLAKQNQAHYSQKMYKLALEESKKKGHDLRFDAIPIQAAKASREIASDYKYKEGYRKQLGHHIGARNIEDDPKMMWSMHVAKIQSDREYKKAFEKTKTHFSSPVDMLGIVLAKKCQELVSDVDYRHYLHQWICLPDQNDVIHARKAYDLQSDAVYKSDLEWLKGIGWVPIGSLDVEKAKKAGEILSDRKYRQPADQIKFTSVTDSLAMMLAKHNAEIMNKRLYTEAWDADKTSIHVMPDTPTILLAKANAANVSHKHYVQAWEDAKKKGYDMRADAIPIRSAKASRDIASDYKYKEAHEKQKGHYIGCRTAKEDPKLSWAARAMLLQNDRIYRKAYNDSKAHIHMPVDAMSLQAAKECQTLVSDVDYRHYLHQWTCLPDQNDVMHARKAYDLQSDNVYKSDLEWLRGIGWLTEGSVDVIKAKKAQEILSDRLYRTQPDKMKFTSITDTPDVVQAKINAMQLSNHLYREVWDKDKTQISIPSDTPELLQSKLNALNISNKHYQKAWDEAKAKNYDLRADAIPIKHAKASRDIASEYKYKEAHEKQKGHYIGCRTAKEDPKLSWAARAMLLQNDRIYRKAYNDSKAHIHMPVDAMSLQAAKECQTLVSDVDYRHYLHQWTCLPDQNDVMHARKAYDLQSDNVYKSDLEWLRGIGWLTEGSVDVVKAKKAQEILSDRLYRTQPDKMKFTSVTDAPDVVQAKINAMQLSNRLYREAWDKDKTQISIPSDTPEMLQSKVNALNISNKHYQKAWDEAKAKNYDLRADAIPIKHAKASRDIASEYKYKEAHEKQKGHYIGCRTAKEDPKLSWAARAMLLQNDRIYRKAYNDSKAHIHMPVDAMSLQAAKECQTLVSDVDYRHYLHQWTCLPDHNDVVHARKAYDLQSDAVYKSDLEWLRGIGWLPNDSPGVQRVKHAQDLLSDKVYRTPIDSVKYTSVVDSPDILLAKMNAEQLSIPKYKEAWEKDKTMIHIMPDTPEITLARSNAHNYSQKLYKEAWDEVKMSYDLRADAIPIKAAKASREIASDYKYKLDHEKQKGHYVGVPNAKADTKIRFALGIGKVQSELEYKKHFAKWKTQCHLPVDMLSIQSAKHGQSLVSDVDYRHYLHQWICLPDQNDVIHARKAYDLQSDAVYKSDLEWLRGIGWLPNDSLGINHVKHAGDLLNERKYRTKAETLHFTPVADRVDYVTAKKSGEILSDIKYHKDWNEVKSNYTLTDTPQLDMAREAARILNQSLYKESWEKEKATGYLLPPDTVQIRHAKHSNDVQSELKYKADYVKQRGHYVGVASMRDDPKLVWFEHAGEIQNDRLYKSNYHKTKSKIHIPADIMSVVAAKECQALVSDVDYRHYLHQWTCHPDQNDCIQARKAYDLQSDNIYKSDLEWLRGCGWIPLGSVEHKKVKHAQELINKRAYTKDAIENFSKYTSVVDTPDIVLAKINSVNQSDLKYKETFNLEKGQYIGSDDTPELNHARDMSLLYSDKLYKRDWEVCKPIGYTLDAKYIPLVGAKHANYVNSELKYKEIYEKLKGHYLAGKDIGDFPSVVHSLAFQKIRSALAYRKNYEDTKTRVHIPSDMMNHVLAKKCQYILSDLEYRTYLHHWNCSPEEHDVIQARRAQEILSDVVYKDDLNWLKGIGCYVWDTPQILHAKKSYDLQSQIKYTAAGKENFQNFGVVTDTPVYVTAVQSGINASDVKYKEDYHKTKDKYTTVTETADSERVQNLKHLFSNNLYKEAWDRVKATSYIMPSDAVSLARAKELKHNASIVKYREEYDKFKALYTLPRSVEDDPNTARCLRVGKLNIDRLYKETYEKNKAKVHIIPDMVDIIAAKDAQKKISEIDYRTHLHDWICLPDLQINAHVRKVADQISDVVYKDDLNWLKGIGCFVWDTPEILHAKHAYDLRSDIKYKSDADKMKSKYTVVMDTPVYVQNILSGLNASEVIYRGDYLKKVRGKMIPTDKTVDLQRAHHANKIQSENLYRWAGLKALPTGYSLPKDTPGFQHAKHVQHIGSDLKYKEAYEHMKAKGYTLGPNDVGFENVKKVNQVINERLYRATYHKNKDKIHTTPDTPEIRQVRATQEAVSDLIYKSDFFKLQGHLISLPFTPQVLHCRYVGDITSDNKYKEDLKWLQGLGCFLYDTPDMVRARQLRKLWSNYVYTDSAKKMRDKYSVVLDTPGYRTVQELKTHLSDLVYRAAGKELKTKYTSVLNTPDFLRAKEGQRIQSQYLYVALATKERPHHHAGNQTPAFTHARHVKDMVSETKYKIQYEKMKDKYTPVLDTPILIRAKRAYLNASDLRYKETFENTKGKYHTVKDALDIVYHRKVTDDISSVKYKENYMSQLGIWRSIPDRPEHFHHRAVTDAISDVKYKEDLSWLRGIGCYAWDTPDFALAEKNKVLYSGHKYKETFEKTKSHFKYVADSPINRHFKHATQLLDAKLYKAAYEKLKDRYSVIVDDPKNLLAKWGTTLSSQVEYKKDYEKKKDKYTTVVDTPENIRTAKVNKQISDIIYKLEYNKAKPKGYTTIHDTPMLLHVRKVKDRISDLKYKELYERNKSHCNVVADSVHIKTPRHAYKLNSNLDYKKKYEAAKAHWHWIADRPDFVQAAKSSLQQSDYEYKLDREYLKGCKLSVTDDKNTVLALNNAILASDIKYKEKHNKARGTCLVVPDTPQILLAKNVSSLVSENKYKEHSKKQLPRGSYTTLPETRDTAHVKEVTKNVSDTNYKKKFVKEKGKSNYSIMLEPPEVKHAMEVAKKQSTVEYKKDAKSKLHYTPIADRPDIKKATQAAKLISDIEYKKRGEAGLGVTMLGRPDIELAKEVSKLTSQVKYKENFSKEKGKKPKYDLKEAKIYKTMKDAHNIASEVKYKADLKKLHKPVTDMSESLIMNHVLNTSQLASAYQYKKQYEKSKGHYHMVPDNLEQVHLREASELQSHVKYKEKYEKEKGKPMLDFETPTYLTAKESQLMQSEKEYKRDFEESIKGRNLTGLEITPSLLHVKYATKIASEKEYRKDLEEGVKGKGLSVLEETPDMLRAKNATQILNEKEYKKALELEIKGKGLSELALETPDFVRAKNATDIASQIKYKQLAEMEKANYTSVVDTPEIIHAQQVKNLSSQKKYKEEAEKTMPYYVPVADTPEMQRVRENQKNFSTLQYQWDLQNSKGKVTVVQDTPEMLRVKENQKNFSSILYKEDIGTGTTIEKTPEMQRVKRTQDAISSIKYKESIGKGTPIPDLPEVKRVKETQKHISSVLYKEDLGTGIPTPVTPEIERVKRNQEHISSVAYKEGLGTGIPTPVTPEMERVKRNQENISSVLYKENVGMGTPTPVTPEMERVKRNQEHVSSVLYKENVGKVTPTPITPEMERVKRNQEIISSVLYKESLGRATPTPITPEMERVKRNQEQISSVLYKEHLAKGTPTPMTPEMERAKRNQENISSVLYSDSFRKQVQGKAAYVLDTPEMRRVRETQKHISTVKYHEDFEKNKGTFTPVVTDPITERVKKNMHDFSDISYRGIQRRVVEMEQKRVDQDQENLTGLRVWRTNPGSVFDYDPAEDNIQSRSLHMISVQAQRRSREHSRSASALSISGGDEKSEPSEGVNQHLSYYSSGGFFTTTATVGYKHAKTIELPQQRSASVATQQTTVSSVPSHPSTAGKTYRAMYDYTAADADEVSFKDGDTIVNVQAIDEGWMYGTVQRTGKTGMLPANYVEAV

SEQ ID NO: 1643 - protein, 4162 aa, Gallus gallus
MTTKAPTFTQPLQSVVALEGSAATFEAHISGFPVPEVSWYRDGQVLSAATLPGVQISFSDGRAKLVIPSVTEANSGRYTIQATNGSGQATSTAELLVTAGTAPPNFSQRLQSMTARQGSQVRLDVRVTGIPTPVVKFYRDGVEIQSSPDFQILQEGDLYSLIIAEAYPEDSGTYSVNATNNVGRATSTAELLIQGEEEAVPAKKTKTIVSTAQISQTRQARIEKKIETHFDARSLTSVEMVIEGAAAQQLPHKAPPRMPPRPTSKSPTPPVITAKAQMARQQSPSPVRQSPSPVRHVRAPTPSPVRSVSPAGRISTSPIRPVKSPSPIRKAQVVTPGAEVLPPWRQEGYSATAEAQMKETRVSTSATEIRTEERWEGRYGLQEQVTISGAAAGEVAAGAKEVRKEPEKTPVPTVIIATDKAKEQERISTAREEISARHEQVHVSHEQIEAGKRAEAVATVVAAVDQARVRSPWETEQVDETYVKKKTLEYGYKEHAVKDHEAQAEHHVATKEVKTVYVPPEKHIPAAEKKEVHVSTEIKRETEAKIEKTIHIEHPRPRTASPHFTVSKIAVPKPDHTYEVSIAGSAMATLEKELSATSAAQKITKPVKPPQLKPHEVKIKPESAPPQFPFTEAAETYKAHYDVETKKEVDVSIKGEAVREDHLLLRKESEAKVTETARVPVPAEIPVTPPTLVWGLKNKTVTEGESVTLECHISGHPQPTVTWYREDYKIESSMDFQITFKAGLARLVIREAFAEDSGRFTCTATNKAGSVSTSCHLHVKVSEETETRETISEKVVTEEKSYVETKDVVMEDVSAAAEEVSGEPVPPFFIRKPVVHKLIEGGSIIFECQVGGNPKPHVLWKKGGVPLTTGYRYKVSYKRETGECKLEISMTFADDAGEYTIVIRNKFGEASATVSLLEEADYEAYIKSQQEMMYQTQVTAYVQEPKVAEVAPPISYGDFDKEYEKEQALIRKKMAKDTVMVRTFVEDEEFHISSFEERLIKEIELRIIKTTLDELLEEDGEEMMIDISESEAIGAGFDLRLKNYRTFEGTGVTFHCKTTGYPLPKIAWYKDGKRIRHGERYHMEVLQDGSASLRLPVVLPEDEGIYTVFASNMKGNAICSAKLYVEPVAPTATPGYMPGPEVMRRYRSISPRSPSRSPARSSPSRSPARRLDETDEGQLERLYKPVFVLKPTSVKCSQGQTARFDLKVVGRPMPETYWFHNGQQVVNDYTHKIVIKEDGTQSLIIVPAMPEDSGEWAVIAQNRAGKASVSVTLSVEAKEDLVRPRFVERLRNVSVKKGSRLHMAVKATGNPNPDIVWLKNSDIIVPHKYPRIRIEGTKGAAALNIESTARQDAAWYTATAINKAGRDTTRCKVNVEVEHAEPEPERRLIIPKGTYKAKEIAAPELEPLHLRYGQEQWEEGDLYDKEKQQKPFFKKKLTSLRLKQFGPAHFECRLTPIGDPTMVVEWLHDGKPLEAANRLRMINEFGYCSLDYGVAYSRDSGVITCRATNKYGTDHTSATLIVKDEKSLVEESQLPEGRRGMQRIEELERMAHEGALPAVAVDQKEKQKPELVLVPEPARVLEGETARFRCRVTGYPLPKVNWYLNSQLIRKSKRFRLRYDGIHYLDIVDCKSYDTGEVKVTAENPEGFIEHKVKLEIQQREDFRSVLRRAPEPRHEPVVTEPGKLLFEVQKIDKPAEATTKEVVKLKRAERITHEKLSEESEELRSKFKRRTEEGYYEAITAVELKSRKKDESYEEMLKKTKEELLHWTKEIPEEEKKALPPEGKITIPTFKPEKVELSPSMEAPKIFERIQSQTVAQGTDAHFRVRVVGKPDPECQWFRNGVQIERTDRIYWYWPEDNVCELVIRDVTADDSASIMVKAVNIAGETSSHAFLLVQAKQLISFIQNLQDVVAKERDSMATFECETSEPFIKVKWFKNGIEIHSGEKYRMHSDRKAHFLSVLAVEMSDADDYSCALVEDESVKTTAKLIVEGAVVEFIKELEDVEVPESFTGELECEVSPEDIEGKWYHGDVELSSNHKYVLASRRGRRILTIKDVNKDDQGEYSFVVDGKRTHCKLKMKPRPMTILQGLTDQKVCEGDIVQLEVKVSVENVEGVWMKDGHEIQSSDRIHIVLDKQSHMLLIEDATQEDSGTYSFSIPGLELSTTGQVTVYSVEIIVPLKDVHVVEGTKAILECKVSAPDVTSSKWYLNDHQIKPDERVQAVCKGTKQRLVITRTHASDEGHYKLMVGKVETSCNVTVEEIEIIRGLHDITCTETQNVSFEVELSHSGIDVIWHFKGQEIKAGPKYKIEARGKIYKLTVVKMMKDDEGEYVFYAGGKKTSGKLIVAGGAISKPLADLTVAESQRAVFECEVANPESEGQWLKNGKPLPMTDQYRAETDGVKRRLNIPAAKMDDMGEYSYEIASSKTSAKLHVEAVKIKKTLKNLTVTETQEAVFSVELSHPDVKGALWIKNGVELESNDKYEISVKGTVHTLKIKHCVVTDESVYSFKLGKIGANARLHVETVKIIKKPKDVTALENAVVSFELSVSHDTVPVRWFHKNVELKQSDKYKMISQRKVHKLMLHNISPADAGEYTAFVGQLECKAKLFVETIHITKTMKSIEIPETKTASFQCEVSHFNVPSVWLKNGVEIEMSEKFKIVVQGKLHQLNIMNTSSEDSAEYTFVCGNDRVSATLTVKPILITSMLEDINAEEKDTITFEVTVNYEGISYKWLKNGVEIKSTDKCQIRTKKLTHSLSIRNVHFGDAAEYSFVAGKAASSATLYVEARHIEFRKHIKDIKVVEKKRAIFECEISEPDVQVQWMKDGQELQIGDRMKIQREKYVHRLIIPSTKMSDAGQYTVVAGGNTSSANLIVEGRDIRIRSIRKEIQVIERQRAEIEFEVNEDDIEPQWYKDGIEINFHYEERYSYVVERRIHRMSIFETTYSDAGEYTFVAGRNRSSVVLYVNAPEPPQIIQELQPTTVESGKPARFCAIISGKPQPKVSWYKDDQQLSPGFKCKFLHDAQEYTLLLIETFPEDSAVYTCEAKNDYGVATTSASLSVEIPEVVSPELEVPVYPPAVIVPLRDAVTSEGQSARFQCRVTGTDLKVSWYSKDREIKPSRFFRMTQFEDTYQLEIAEAYPEDEGTYTFVASNSVGQVTSTAILKLEAPEKIMYEKLEEEIEMEVKVAPILRRRLEPLEVAVNHVAKFTCEVETTPNVKFQWYKAGREIYDGDKYSIRSSNYLSTLEIPRPQVVDCGEYSCKASNQHGSVSSTAFLTVTEPPRFIKKLDSSRLVKQHDSTRYECKVGGSPEIKVTWYKGETEIHPSEKYSMSFVDSVAVLEMHNLSVEDSGDYSCEAQNPAGSASTSTSLKVKAPPAFTKKPHPVQTLKGSDVHLECELQGTPPFQISWYKDKREIRSSKKYKVMSENYLASIHILNVDTADVGEYHCKAVNDVGSDSCIGSVTLRAPPTFVKKLSDVTVVVGETIELQAAVEGAQPISVLWLKDKGEIIRESENLWISYSENVASLKIGNAEPTNAGKYICQIKNDAGFQECFAKLTVLEPAVIVEKPGPVKVTAGDSCTLECTVDGTPELTARWFKDGNELSTDHKYKISFFNKVSGLKILNAGLEDSGEYTFEVKNSVGKSSCTASLQVSDRIMPPSFTRKLKETYGQLGSSAVLECKVYGSPPILVSWFHDGQEITSGDKYQATLTDNTCSLKVNGLQESDMGTYSCTATNVAGSDECSAFLSVREPPSFVKKPEPFNVLSGENITFTSIVKGSPPLEVKWFRGSIELAPGHKCNITLQDSVAELELFDVQPLQSGDYTCQVSNEAGKISCTTHLFVKEPAKFVMKVNDLSVEKGKNLILECTYTGTPPISVTWKKNGVILKHSEKCSITTTETSAILEIPNSKLEDQGQYSCHIENDSGQDNCHGAITILEPPYFVTPLEPVQVTVGDSASLQCQVAGTPEMIVSWYKGDTKLRGTATVKMHFKNQVATLVFSQVDSDDSGEYICKVENTVGEATSSSLLTVQERKLPPSFTRKLRDVHETVGLPVTFDCGIAGSEPIEVSWFKDNVRVKEDYNVHTSFIDNVAILQILKTDKSLMGQYTCTASNAIGTASSSGKLVLTEGKTPPFFDTPITPVDGIIGESADFECHISGTQPIRVTWAKDNQ

SEQ ID NO: 1644 - protein, 377 aa, Gallus gallus; identical to SEQ ID NO: 898

SEQ ID NO: 1645 - protein, 381 aa, Gallus gallus
MPFSSTHNKHKLKFSAEEEFPDLSKHNNHMAKVLTPELYKRLRDKETPSGFTLDDVIQTGVDNPGHPFIMTVGCVAGDEESYEVFKDLFDPVIQDRHGGYKPTDKHRTDLNHENLKGGDDLDPKYVLSSRVRTGRSIKGYSLPPHCSRGERRAVEKLSVEALNSLEGEFKGRYYPLKAMTEQEQQQLIDDHFLFDKPVSPLLLASGMARDWPDARGIWHNDNKTFLVWVNEEDHLRVISMEKGGNMKEVFRRFCVGLKKIEEIFKKAGHPFMWTEHLGYILTCPSNLGTGLRGGVHVKLPKLSQHPKFEEILHRLRLQKRGTGGVDTAAVGAVFDISNADRLGFSEVEQVQMVVDGVKLMVEMEKKLEQNQPIDDMIPAQK

SEQ ID NO: 1646 - protein, 530 aa, Gallus gallus
MSKHHDAGTAFIQTQQLHAAMADTFLEHMCRLDIDSEPTIARNTGIICTIGPASRSVDKLKEMIKSGMNVARLNFSHGTHEYHEGTIKNVREATESFASDPITYRPVAIALDTKGPEIRTGLIKGSGTAEVELKKGAALKVTLDNAFMENCDENVLWVDYKNLIKVIDVGSKIYVDDGLISLLVKEKGKDFVMTEVENGGMLGSKKGVNLPGAAVDLPAVSEKDIQDLKFGVEQNVDMVFASFIRKAADVHAVRKVLGEKGKHIKIISKIENHEGVRRFDEIMEASDGIMVARGDLGIEIPAEKVFLAQKMMIGRCNRAGKPIICATQMLESMIKKPRPTRAEGSDVANAVLDGADCIMLSGETAKGDYPLEAVRMQHAIAREAEAAMFHRQQFEEILRHSVHHREPADAMAAGAVEASFKCLAAALIVMTESGRSAHLVSRYRPRAPIIAVTRNDQTARQAHLYRGVFPVLCKQPAHDAWAEDVDLRVNLGMNVGKARGFFKTGDLVIVLTGWRPGSGYTNTMRVVPVP

SEQ ID NO: 1647 - protein, 1132 aa, Gallus gallus
MPEPSKAAPKKEAKKKEEKKEEKKEAPPPQEHKDEAPDDVHPPETPDPEGLFLSKPQNVMVESGRDVTVSARVAGAALPCAPAVKWFKGKWAELGDKSARCRLRHSVDDDKVHTFELTITKVAMGDRGDYRCEVTAKEQKDSCSFSIDVEAPRSSEGNVLQAFKRTGEGKDDTAGELDFSGLLKKREVQVEEKKKKKDEDDQFPPEIWELLKGVTKKSEYERIAFQYGITDLRGMLKRLKKVHVEPKKSEAFIRKLDPAYQVDKGNKIKLVVELSDPDLPLKWYKNGQLLKPSTKYVFENVGLKRILTIHKCSLADDAAYECRVNDEKCFTEVFVKEPPVTVVRGLEDQQVVVGDRVVLEAEVSEEGAQVMWLKDGVDVTRDDAFKYRFKKDGKKHFLIINEAELSDSAHYKIMTNGGESEAELSVEEKQLEVLQDMADLTVKASEQAVFKCEVSDEKVTGRWFRNGVEVKPSKRIHISHNGRFHKLVIDDVRPEDEGDYTFIPDGYALSLSAKLNFLEIKVEYVPKQEPPKIHLDCSGKAAENTIVVVAGNKVRLDVPISGEPAPTVTWKRGDQLFTATEGRVHIDSQADLSSFVIESAERSDEGRYCITVTNPVGEDSATLHVRVVDVPDPPQSVRVTSVGEDWAVLSWEAPPFDGGMPITGYLMERKKKGSMRWMKLNFEVFPDTTYESTKMIEGVFYEMRVFAVNAIGVSQPSLNTQPFMPIAPTSEPTHVVLEDVTDTTATIKWRPPERIGAGGVDGYLVEWCREGSNEWVAANTELVERCGLTARGLPTGERLLFRVISVNMAGKSPPATMAQPVTIREIVERPKIRLPRHLRQTYIRRVGEQVNLVIPFQGKPRPQVTWSREGGALPAEVQTRTSDVDSVFFIRSAARPLSGNYEMRVRIDNMEDCATLRLRVVERPGPPQAVRVMEVWGSNALLQWEPPKDDGNAEISGYTVQKADTRTMEWFTVLEHSRPTRCTVSELVMGNEYRFRVYSENVCGTSQEPATSHNTARIAKEGLTLKMVPYKERDLRAAPQFLTPLVDRSVVAGYTVTLNCAVRGHPKPKVTWLKNSVEIGADPKFLSRHGLGVLSLLIRRPGPFDGGTYGCRAVNEMGEATTECRLDVRVPQ

SEQ ID NO: 1648 - protein, 375 aa, Gallus gallus; identical to SEQ ID NO: 862

SEQ ID NO: 1649 - protein, 417 aa, Gallus gallus
MSLSNKLTLDKVDVKGKRVVMRVDFNVPMKDHKITNNQRIKAAVPTIKHCLDHGAKSVVLMSHLGRPDGVPMPDKFSLAPVAVELKALLGREVSFLKDCVGPEVEKACANPANGSVILLENLRFHVEEEGKGKDASGNKIKADAAKVEAFRASLSKLGDVYVNDAFGTAHRAHSSMVGVHLPQKAAGFLMKKELDYFAKALESPERPFLAILGGAKVQDKIQLISNMLDKVNEMIIGGGMAFTFLKVLNNMQIGNSLFDEEGSKIVKDLMAKAEKNGVKITLPVDFITADKFDEHAQTGEATVASGIPAGWMGLDCGPESVKKFVEVVGRAKQIVWNGPVGVFEWDKFSKGTKALMDKVVEVTGKGCITIIGGGDTATCCAKWNTEDKVSHVSTGGGASLELLEGKVLPGVDALSSV

SEQ ID NO: 1650 - protein, 434 aa, Gallus gallus
MSIQKIHAREILDSRGEPTVEVDLHTAKGHFRAAVPSGASTGIHEALEPRDGDKKRFLGKGVLKAVEHINKTIGPALIEKKISVVEQEKIDKVMIEMDGTENKSKFGANAILGVSLAVCKAGAAEKGVPLYRHIADLAGNTELILPVPAFNVINGGSHAGNKLAMQEFMVLPVGAASFHDAMRVGAEVYHSLKGVIKAKYGKDATNVGGEGGFAPNILDNHEALELLKAAIAQAGYTDKVVIGMDVAASEFCRDGRYHLDFKSPPHTKRYITGEQLGEIYRGFIKDYPVVSIEDPFDQDDWEAWKRFVFHVDIQVVGDDLTVTNPKRIAHGAEQHACNCLLLKVNQIGSVTESIQACKLAQSHGWGVMVSHRSGETEDTFIADLVVGLCTGQIKTGAPCRSERLAKYNQLMRIEEALGDKAKFAGRKFRNPKAK

SEQ ID NO: 1651 - protein, 897 aa, Gallus gallus
MNSMNQIETNMQYTYNYEEDEYMTQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHLSWKDGLGLCALIHRHRPDLIDYSKLNKDDPIGNINLAMEIAEKHLDIPKMLDAEDIVNTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHEQWAYGKEQILLQKDYESASLTEVRAMLRKHEAFESDLAAHQDRVEQIAAIAQELNELDYHDAASVNDRCQKICDQWDSLGTLTQKRREALERTEKLLETIDQLHLEFAKRAAPFNNWMEGAMEDLQDMFIVHSIEEIQSLISAHDQFKATLPEADGERQAILSIQNEVEKVIQSYSMRISASNPYSTVTVEEIRTKWEKVKQLVPQRDQSLQEELARQHANERLRRQFAAQANVIGPWIQTKMEEIARSSIEMTGPLEDQMNQLKQYEQNIINYKHNIDKLEGDHQLIQEALVFDNKHTNYTMEHIRVGWELLLTTIARTINEVETQILTRDAKGITQEQMNDFRASFNHFDRRKNGLMDHDDFRACLISMGYDLGEAEFARIMSLVDPNGQGTVTFQSFIDFMTRETADTDTAEQVIASFRILASDKPYILADELRRELPPEQAQYCIKRMPQYTGPGSVPGALDYTSFSSALYGESDL

SEQ ID NO: 1652 - protein, 994 aa, Gallus gallus
MENAHAKTAEECLAFFGVNESVGLSGEQVRRALEKYGHNELPAEEGKTIWELVVEQFEDLLVRILLLAACISFVLAWFEEGEETITAFVEPFVILLILIANAVVGVWQERNAENAIEALKEYEPEMGKVYRADRKAVQRIKARDLVPGDIAEVAVGDKVPADIRIISIKSTTLRVDQSILTGESVSVIKHTEPVPDPRAVNQDKKNMLFSGTNIGAGKAVGIVVATGVNTEIGKIRDEMAATEQDKTPLQQKLDEFGEQLSKVISLICVAVWLINIGHFNDPVHGGSWIRGAIYYFKIAVALAVAAIPEGLPAVITTCLALGTRRMAKKNAIVRSLPSVETLGCTSVICSDKTGTLTTNQMSVCKMFIVDKVEGDVCSLNEFSITGSTYAPEGDVLKNEKHIKAGQHDGLVELATICALCNDSSLDYNEAKGIYEKVGEATETALTCLVEKMNVFNTDVRSLSKVERANACNSVIKQLMKKEFTLEFSRDRKSMSVYCSPAKASRAAVGNKMFVKGAPEGVIDRCNYVRVGTTRVPLTPAVKEKILAVIKEWGTGRDTLRCLALATRDTPPKMEDMMLVDSTKFAEYETDLTFVGCVGMLDPPRKEVMGSIRLCRDAGIRVIMITGDNKGTAIAICRRIGIFTEDEEVSGRAYTGREFDDLPPAEQREACRRACCFARVEPTHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDKPPRSPKEPLISGWLFFRYLAIGGYVGAATVGAAAWWFLYAEDGPSLTYHQLTHFMQCTHHNAEFEGVDCDIFESPVPMTMALSVLVTIEMCNALNSLSENQSLLRMPPWVNIWLVGSICLSMSLHFVILYVDPLPMIFKLTHLDLAHWLVVLRISFPVILLDEALKFVARNYLEA

SEQ ID NO: 1653 - protein, 333 aa, Gallus gallus
MVKVGVNGFGRIGRLVTRAAVLSGKVQVVAINDPFIDLNYMVYMFKYDSTHGHFKGTVKAENGKLVINGHAITIFQERDPSNIKWADAGAEYVVESTGVFTTMEKAGAHLKGGAKRVIISAPSADAPMFVMGVNHEKYDKSLKIVSNASCTTNCLAPLAKVIHDNFGIVEGLMTTVHAITATQKTVDGPSGKLWRDGRGAAQNIIPASTGAAKAVGKVIPELNGKLTGMAFRVPTPNVSVVDLTCRLEKPAKYDDIKRVVKAAADGPLKGILGYTEDQVVSCDFNGDSHSSTFDAGAGIALNDHFVKLVSWYDNEFGYSNRVVDLMVHMASKE

SEQ ID NO: 1654 - protein, 817 aa, Gallus gallus
RESDHRAWTPVSYTVTRQNAVVQGLTEGKAYFFRIAAENIIGMGPFTETTKELIIRDPITVPDRPEDLEVKAVTKNSVTLTWNPPKYNGGSDITMYVLESRLIGKEKFHRVTKEKMLDRKYTVEGLKEGDTYEYRVSACNIVGQGKPSFCTKPITCKDEIAPPTLDLDFRDKLIVRVGEAFSLTGRYSGKPTPKITWLRDDIVLKEDDRTKIKTTPTTLCLGILKSVREDSGKYCVTVENSTGSRKGFCQVTVVDRPSPPVGPVIFDEVHKDHMIVSWKPPLDDGGSEITNYIIEKKDTHRDLWMPVTSATVKTTCKIPKLLEGREYQVRIYAENLYGISDPLISDEMKAKDRFSVPDAPEQPVIKDVTKDSAVVVWNKPYDGGKPITNYIVEKKETMATRWVRVTKDPIFPSTQFKVPDLLEGCQYEFRVSAENEIGVGNPSPPSKPIFARDPIVKPSPPVNPEAVDKTKNSVDLTWQPPRHDGNGKIIGYLVEYQKVGDEEWKKANLTPDSCPETKYKVTGLTEGLTYKFRVMAVNAAGESEPAYVPDPVEVKDRLEPPELILDANMAREQHVRAGDTLRLSAVIKGVPFPKVSWKKEDKEVSPKADIEVTGVGSKLEIRNTVHEDGGIYSLTVENPAGSKTVSVKVLVLDKPGPPRNLQVSDVRSDSCYLTWKEPEDDGGSVITNYVVERKDVASAQWVSVSSSSKKRSHMAKYLMEGTQYLFRVAAENLFGRGPYVETLKPIKAMDPLHPPGPPKNLHHIDVDKTEVSLVWNRPDRDGGAEITGYLVEYQEDGADEWTKFQTVPMLDCVVTGL

SEQ ID NO: 1655 - protein, 602 aa, Gallus gallus
MVHIETVKTKAYADQKPGTSGLRKRVTVFQNNAHYAENFIQSILATVPPAERQEATLVVGGDGRFYMKDAIQIIVRIAAANGIGRLVIGQNGILSTPAVSCIIRKIKAIGGIILTASHNPGGPNGDFGIKFNTANGGPAPEGITDKIFQISKKIEEYAICPDLKVDLGTIGKQQFDLENKFKPFTVEIVDSVEAYANMLRNIFDFNALKELLSGKNHLKIRIDAMHGVVGPYVKKILCEELGAPANSAVNCTPLEDFGGHHPDPNLTYAADLVQTMKTGEYDFGAAFDGDGDRNMILGKHGFFVNPSDSVAVIAANIFSIPYFQQTGVRGFARSMPTSGALDRVAHATKIALYETPTGWKFFGNLMDANKLSLCGEESFGTGSDHIREKDGLWAVLAWLSILAARKQSVEDIMKDHWQKYGRNFFTRYDYEEVDADAAGKMMKDLETVMFDRSFVGKQLSAGDKVYTVEKADNFEYNDPVDGSVSRNQGLRLIFSDGSRIIFRLSGTGSAGATVRLYIDSYEKDAKKIHEDPQVMLAPLISIALKLSQLHERTGRTGPCYNIKARPGTKGKKPARRLFYCRVCRYKRNINFICVFKNTARYR

SEQ ID NO: 1656 - protein, 615 aa, Gallus gallus
MKWVTLISFIFLFSSATSRNLQRFARDAEHKSEIAHRYNDLKEETFKAVAMITFAQYLQRCSYEGLSKLVKDVVDLAQKCVANEDAPECSKPLPSIILDEICQVEKLRDSYGAMADCCSKADPERNECFLSFKVSQPDFVQPYQRPASDVICQEYQDNRVSFLGHFIYSVARRHPFLYAPAILSFAVDFEHALQSCCKESDVGACLDTKEIVMREKAKGVSVKQQYFCGILKQFGDRVFQARQLIYLSQKYPKAPFSEVSKFVHDSIGVHKECCEGDMVECMDDMARMMSNLCSQQDVFSGKIKDCCEKPIVERSQCIMEAEFDEKPADLPSLVEKYIEDKEVCKSFEAGHDAFMAEFVYEYSRRHPEFSIQLIMRIAKGYESLLEKCCKTDNPAECYANAQEQLNQHIKETQDVVKTNCDLLHDHGEADFLKSILIRYTKKMPQVPTDLLLETGKKMTTIGTKCCQLPEDRRMACSEGYLSIVIHDTCRKQETTPINDNVSQCCSSSYANRRPCFTAMGVDTKYVPPPFNPDMFSFDEKLCSAPAEEREVGQMKLLINLIKRKPQMTEEQIKTIADGFTAMVDKCCKQSDINTCFGEEGANLIVQSRATLGIGA

SEQ ID NO: 1657 - protein, 1532 aa, Gallus gallus
AMPSHKETRLLHLNEMEKLDKTLFRLEQGFELQFRLGPTLQGKHVTVCTNYPASGEVFDRHKFRTLSWHNPTGKEDDSDKYCKLDLQISGSYQYYFNLGNEKSGGGYIVVDPILRVGADNHVLPLDCVTLQTFLAKCLGPFHEWENRLKVAKETGYNMIHFTPLQKLGLSRSCYSLADQLEVNPEFSSHNKKCTWNDIGALVEKMKNEWNMLCITDVVYNHTAANSEWLRMHPECGYNLVNSPHLKPAWVLDRALWHLSCMVADGRCIDKGVPPLIENDHHLNCIRKIIWEDIYPKIKLWEFFQVDVNKAVQQFRTLLTKGKIGTKSDPNQHLQIVQDPDYRRFGCTVDMNIALATFIPHSNGPGAIEECCNWFRKRIEELNAEQYRHIHHHQEQAVNCLAGTVVYERLAGHGPKLGPISRKYPLVTRYFTYPFKDLTVEEEQSMMHQPDKACYFMAHNGWVMGDDPLRNFAEPGSNVYLRRELICWGDSVKLRYGNKPEDCPYLWAHMKKYTEITAKHFHGVRLDNCHSTPIHVAEYMLDTARKLRADLFVVAELFTGNEELDNIFVNSLGITSLIREAMTAYNSHEEGRLVYRFGGEPVGSFVQPRLRPLVPAIAHALFMDITHDNECPIQHRSAYDALPSAMIVSMACCATGSTKGYDELVPHQISVVSEERFYSTWNPQAHLNSGEVNFQTGILAGRLAMNRLHQELGTKGFNQVYVDQVDEDIVAVTRHCPNTHQSVVAVSRTAFRDPKTSFYSKEVPEMCIPGKIEEVVFEARTIERSVSPYTKDEHFINGLPNFTVELREHIQIKDSKIIKQAGTAIKGPNEFVQEIEFENLTPGSVIVFRVSLDPKAQEAVGVLRNHLIQFSPHFKSGSLPDDHSAPILKTLFSSIASKLTLADLNQVLYRCESEEQEDGGGCYNIPNWSSLKYAGLQGLMSVMADIRPKNDLGHPFCDNLRSGDWMIDYVSNRLISRAGACAEVGKWLKAMFVYLKKIPRYLIPCYFDAILVGAYTTLLDVGWHQMSSFVQNGSTFVKHLSLGSIQMCGIGKYACLPDLSPSLHDVPYRLNEITHEKEQCCVTLAAGLPHFSSGIFRSWGRDTFIALRGLMLLTGRYIEARNIILAFGGTLRHGLIPNLLGQGTHARYNCRDAVWWWLQCIQDYCKIVPNGLDILRCPVSRMYPRDDSAPQPAGSVDQPLYEVIQEAMQRHMEGINFRERNAGPQIDQNMRDEGFNIIAGIDRETGFVFGGNRFNCGTWMDKMGESDRARNKGIPATPRDGSAVEIVGLCKSAVRWLLDLSRKNEYPFHGVTIKRYGREETITYDEWNRKIQGHFERLFFVSENPADQNEKHPNLVHKRGIYKDSYGASSPWCDYQLRPNFTIAMVVAPELFTPERAWKALRIAEEKLLGPLGMKTLDPDDMVYCGIYDNALDNDNYNVARGFNYHQGPEWLWPIGYFLRAKLYFSKLIGPEIYAKTVVMIKNVLSRHYVHLESRSSWKGLPELTNENGQYCPFSCETQAWSIGVILEVLYDL

SEQ ID NO: 1658 - protein, 248 aa, Gallus gallus
MAPRKFFVGGNWKMNGDKKSLGELIHTLNGAKLSADTEVVCGAPSIYLDFARQKLDAKIGVAAQNCYKVPKGAFTGEISPAMIKDIGAAWVILGHSERRHVFGESDELIGQKVAHALAEGLGVIACIGEKLDEREAGITEKVVFEQTKAIADNVKDWSKVVLAYEPVWAIGTGKTATPQQAQEVHEKLRGWLKSHVSDAVAQSTRIIYGGSVTGGNCKELASQHDVDGFLVGGASLKPEFVDIINAKH

SEQ ID NO: 1659 - protein, 1323 aa, Gallus gallus
EPFNVLSGENITFTSIVKGSPPLEVKWFRGSIELAPGHKCNITLQDSVAELELFDVQPLQSGDYTCQVSNEAGKISCTTHLFVKEPAKFVMKVNDLSVEKGKNLILECTYTGTPPISVTWKKNGVILKHSEKCSITTTETSAILEIPNSKLEDQGQYSCHIENDSGQDNCHGAITILEPPYFVTPLEPVQVTVGDSASLQCQVAGTPEMIVSWYKGDTKLRGTATVKMHFKNQVATLVFSQVDSDDSGEYICKVENTVGEATSSSLLTVQERKLPPSFTRKLRDVHETVGLPVTFDCGIAGSEPIEVSWFKDNVRVKEDYNVHTSFIDNVAILQILKTDKSLMGQYTCTASNAIGTASSSGKLVLTEGKTPPFFDTPITPVDGIIGESADFECHISGTQPIRVTWAKDNQEIRTGGNYQISYVENTAHLTILRVDRGDSGKYTCYASNEVGKDSCTAQLNVKERKTPPTFTRKLSEAVEETEGNELKLEGRVAGSQPLTVSWYKNNQEVHSSPHCEISFKNNTLLLHIKSVGQSDAGLYTCKVSNEAGSVLCTSSVVIREPKKPPVFDQPLQPAATEEGDTLQLSCHVRGSEPIRIQWLKAGREIRASERCSFSFANGVALLELAAVTKSDSGEYVCKASNVAGTDTCRSKVTVKEKAAAVSAAKKADIEGKLYFVSEPQSIKVMEKTVATFIAKVGGDPIPNVKWMKGKWRQLNQGGRIIIQQRGDEAKLEIKDTTKTDSGLYKCVAFNQHGEIERSVNLQVEERKQEVVEEDVRGKLKRIPTKKKEDEEQTIDILELLKNVDPKEYEKYARMYGITDFRGLLQAFELLKQTREEESHRLEIELTEKAQKEDQEFEELVAFIQQRLTQTEPVTLIRDIENQTVLTDEDAIFECEIKINYPEIKLSWYKGTQKLDSSDKYKIKIEGDRHILKIKNCQLEDQGNYRIVCGPHIASARLTVIEPAVERHLHDTTFKEGNTCTLSCQFSIPNAKSQWYRNGRPIKIGGRYSTQVSDKVHKLIIKDVRTEDQGQYTCKLDNLETTADLTIEAEPIQFTKSIQNIVVSEHQSATFECEVSFDDAVVTWYKGPTELTESPKYSFRSEGRCHYMTIHNVTAEDEGVYSVIARLEPRGEARSTAELYLVTKEIKLELKPPDVPDAKVAVPPQKPAEAAPIPILLPLIPTPEEKKPAEKKVPVKKVSKKVVKKGPKEIPPPEVPEILPEKPKEVKITSMARREEIHEEKMEIYEKPKKVYEEWEEDYGEDHDYYFKEEGYDEGEEEWEETYDKREVAYEEEQIIHEEVVEVPKKPVPERKPPAITAEKKEKK

SEQ ID NO: 1660 - protein, 844 aa, Gallus gallus
MAAPLSDGERRKQISVRGIAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAGAHEDQGQPELCLPSYGYGIRYEFGIFNQKIIDGWQVEEADDWLRYGNPWEKARPEYMLPVHFYGRVEHSPEGVKWVDTQVVLAMPYDTPVPGYKNNTVNTMRLWSAKAPNDFNLQEFNVGDYIEAVLDRNLAENISRVLYPNDNFFEGKELRLKQEYFVVAATLQDIIRRFKSSKFGCQDPVRTSFETFPDKVAIQLNDTHPALSIPELMRILVDVEKVDWDKAWEITKQTCAYTNHTVLPEALERWPVSMFEKLLPRHLEIIYALNQMHLDRVAALYPGDVDRLRRMSVIEEGDCKRINMAHLCVIGSHAVNGVARIHSDIVKNTVFKDFYELEPEKFQNKTNGITPRRWLLLCNPGLADVIAEKIGEDFVTDLSQLKKLLDFINNETFIRDVAKVKQENKLKFSAYLEERYKVKINPSSMFDIQVKRIHEYKRQLLNCLHAITLYNRIRSDPSKSFVPRTIMIGGKAAPGYHMAKMIIKLITSIGEVVNNDPYVGDKLKVIFLENYRVSLAEKVIPAADLSQQISTAGTEASGTGNMKFMLNGALTIGTMDGANVEMAEEAGEENLFIFGMRVEEVEALDRRGYNAREYYDRIPELRQAIDQISSGFFSPRDPGCFRDVVNMLMHHDRFKVFADYEAYIKCQGQVDQLFMDPREWTKKVIRNIACSGKFSSDRTITEYAREIWGVEPSATKIPPPNLPRD

SEQ ID NO: 1661 - protein, 1450 aa, Gallus gallus
MSSVAVPFYQRRHKHFDQSYRNIQTRYVLEEYAARKAASRQAAHYESTGLGKTTCRLCARRARSLAHEAMQESRKRTHEQKSHASDEKRIKFASELSSLEREIHMARHHAREQLDRLAIQRMVEENMALERHVVEEKISRAPEILVRLRSHTVWEKMSVRLCFTVQGFPSPVVQWYKNEELITPASDPAKYSVENKYGVHVLHINRADFDDSATYSAVATNIHGQASTNCAVVVRRFRESEEPHPAGIMPFHLPLSYDVCFTHFDVQFLEKFGVTFATEGETLTLKCSVLVTPELKRLRPRAEWYRDDVLIKDSKWTKLYFGEGQAALSFTHLNKDDEGLYTLRMVTKGGVNECSAFLFVRDADALIAGAPGAPMDVKCHDANRDYVIVTWKPPNTTSQNPVIGYFVDKCEVGLENWVQCNDAPVKICKYPVTGLYEGRSYIFRVRAVNSAGISRPSRVSEPVAALDPVDLERTQTVHVDEGRKIVISKDDLEGDIQIPGPPTNVHASEISKTYVVLSWDPPVPRGREPLTYFIEKSMVGSGSWQRVNAQVAVKSPRYAVFDLAEGKPYVFRVLSANKHGISDPSEITEPIQPQDIVVVPSAPGRVVATRNTKTSVVVQWDKPKHEENLYGYYIDYSVVGSNQWEPANHKPINYNRFVVHGLETGEQYIFRVKAVNAVGFSENSQESEAIKVQAALTCPSYPHGITLLNCDGHSMTLGWKAPKYSGGSPILGYYIDKREANHKNWHEVNSSVISRTIYTVEDLTEDAFYEFKIAAANVVGIGHPSDPSEHFKCKAWTMPEPGPAYDLTVCEVRNTSLVLLWKAPVYEGKSPITGYLVDYKEVDTEDWITANEKPTSHRYFKVTDLHQGHTYVFKVRAVNDAGVGKSSEISEPVFVEASPGTKEIFSGVDEEGNIYLGFECKEATDASHFLWGKSYEEIEDSDKFKIETKGDHSKLYFKHPDKSDLGTYCISVSDTDGVSSSFVLDEEELERLMTLSNEIKNPTIPLKSELAYEVLDKGEVRFWIQAESLSPNSTYRFVINDKEVENGDRHKISCDHSNGIIEMVMDKFTIDNEGTYTVQIQDGKAKNQSSLVLIGDAFKAILAESELQRKEFLRKQGPHFSEFLYWEVTEECEVLLACKIANTKKETVFKWYRNGSGIDVDEAPDLQKGECHLTVPKLSRKDEGVYKATLSDDRGHDVSTLELSGKVYNDIILALSRVSGKTASPLKILCTEEGIRLQCFLKYYNEEMKVTWSHRESKISSGEKMKIGGGEDVAWLQITEPTEKDKGNYTFEIFSDKESFKRTLDLSGQAFDDALTEFQRLKAAAFAEKNRGKVIGGLPDVVTIMDGKTLNLTCTVFGNPDPEVVWFKNDKALELNEHYLVSLEQGKYASLTIKGVTSEDSGKYSIYVKNKYGGETVDVTVSVYRHGEKIPEVNQGQLAKPRLIPPSSST

SEQ ID NO: 1662 - protein, 333 aa, Gallus gallus
TMSLKDHLIHNVHKEEHAHAHNKISVVGVGAVGMACAISILMKDLADELTLVDVVEDKLKGEMLDLQHGSLFLKTPKITSGKDYSVTAHSKLVIVTAGARQQEGESRLNLVQRNVNIFKFIIPNVVKYSPDCKLLIVSNPVDILTYVAWKISGFPKHRVIGSGCNLDSARFRHLMGERLGIHPLSCHGWIVGEHGDSSVPVWSGVNVAGVSLKALHPDMGTDADKEHWKEVHKQVVDSAYEVIKLKGYTSWAIGLSVADLAETIMKNLRRVHPISTAVKGMHGIKDDVFLSVPCVLGSSGITDVVKMILKPDEEEKIKKSADTLWGIQKELQF

SEQ ID NO: 1663 - protein, 6635 aa, Gallus gallus
MDYSSFSGVPRFLTRPKAFMVSVGKDATLSCQIIGNPIPVVSWEKDKLPIQSGGRFKTTEDGDLYQLTIYDLSLEDSGQYICRAKNTIGEAFAAVSIKVGEETTVTESAPYFIQKPSSIKVTLGEDAMFKCKVQGSPPLSVNWEKDGRHLRNRADAGRFQIESAGESNALTIQCTRLGDSGTYTCRAENPIGSASASAALVVESLGSSNPGSHFDPSCGKTTSLLSHLQKRREEITTKGARNAMFGTLTRTCSVTEGKHAKLSCYVTGEPKPEIVWKKDNEVIVEGRRHVIYEDDQENFVLKILYCKQVDNGLYTCTASNLAGQTYSSVLVTVKEPPIPFKEKLKDLEVWEKESATFQCEVPVPSTETSWFKEETKLRQSKKYNIEEEGTYRRLTVQNVTADDDAVYICEMKEGSRTIAELSVQGNIIKKLPRKTAVSVNDTATFCVELDNECQNICWLKNTEEVKPSDRISIIRSGKQHTMIIRECTMEDAGEIVFLADESRTSTQFTVTTPRKPPTQPPVDPVVKNKTETSVTLAWSPPKMHRPIPIDGYIVERKKLTGFTWVRCHESHVPVPEFTVSDLSEEADYQFRVSAVNAHGQSPYLEFPGSMHLEPVLAVKSPLTTGEAVPGGDAMFTIDLTTICSGTWYLNGKVLQESETCIIKRTQTTHSLIIKNVTKNDDGAEVKFVAKNIDVSTKMRVRGAAVRFTNKSKDVEKISARLREEARLQAEISDTDAAVKWMKDGKELKANEKYELQIVGKRHILKIHNVAMEDAGTYQCTCEGDKMLYQLSVKALATFVNKEKTGGVIRAIAGKQAEFVFETSEANVMVKWYKNGKEITTSKKFTMEDKGKLHKLVASAVTKEDEGTYICKIGDDTLIFDLKVSEKEDVFTNKEKVQKEVKAVLTQNATLSCEVGQEKTEVKWYKEGKLITSSKKFRVESEGKLRRLVVSQVEKKDAGEYTCEAAGQKLTFKITVTVPEAEDAFINKEKVQKEVKAAPTENATLSCEVAQEKTEVKWYKEGKLITSSKKFRVESEGKLRRLVVSQVEQRDAGEYTCEAAGQKLTFKITVTEAEDAFINKEKVQKEVKAAPTENAMLSCEVGQEKSEVKWYKEGKLITSSKKFRVESEGKLRRLVVSQVEQRDAGEYTCEAAGQKLTFKITVTEAEDAFINKEKVQKEVKAAPTENATLSCEVGQEKSEVKWYKEGKLITSSKKFSVESEGKLRRLVVSQVEKRDAGEYTCEAAGQKLTFKITVTEPEVVFINKEKVQKEVKAAPTENATLSCEVGQEKTEVKWYKEGKLITSSKKFRVESEGKLRRLVVSQVEKKDAGEYTCEAAGQKLTFKITVTEAEDAFINKEKVQKEVKAAPTENATLSCEVGQEKSEVKWYKEGKLITSSKKFRVESEGKLRRLVVSQVEKRDAGEYTCEAAGQKLTFKITVTEPEVVFINKEKVQKEVKAAPTENATLSCEVGQEKTEVKWYKEGKLITSSKKFRVESEGKLRRLVVSQVEKKDAGEYTCEAAGQKLTFKITVTEPEVVFINKEKVQKEVKAAPTENATLSCEVGQEKTEVKWYKEGKLITSSKKFRVESEGKLRRLVVSQVEKKDAGEYTCEAAGQKLTFKIDVTDSEPKPVFINQEKVQREVSAVLAESAALSCEVAQDTTEVKWYKDGRLLASSRKFKMETVGKTRRLVVEQLEKKDAGEYVCEAAGQRLTFKLEATEPEAKFEKEFVQKEPLIVQEHESITLTTSVTPETAVVKWYKDGREIKASKKYEIKSDGASRTLTVNLAESTDTAVYACQTKNDKQEFKVEVKEIPVKFTKKLEAVNAEIGGSVTLTCEVSHAKGKVVWRRNAVEIKPSKRFQIHEEGVRRTLTITGIRAEDEGEYFCESRDDKSSITITPKAPRVVKFVTSLNNVASEEGKEAVFKCTVSPSDAVVTWFRNGVKIEASKKYVISQKDTNHSLTITDLTLEDAAEISANAEGVESTANLRVREASISFKKKLEPKTVEEKDTVTLEVELTKPAEVKWMRNSIVLKPSEKIEIKAEGTKHILIVKDISFADRGFYCCESPDDKTQAKINVEMRQIKLVKGLQPLEVSEKGTVTFSVEVSHEDVEGTWQKDGVRLKPAPNVTMAVQGKKHSLTLSSVTLEDAGLISFKAEGINSSGKLTVTELPVKISKPLADINITQKDKVTFECELSRPNVDVKWFKDGKELRQSKKVGIISQGNKRSLVIHKCEYEDQGTYTCQAAEDKTSATLKVHAGKTYSLTYTRVQVKDAAEIKFVAEKAESRAHLTVKELPVKIVKPLRDKIALEKHRGFLECQVSRANAEVKWYKKDVEIHPSDKYEIVSDGVYRKLIINDADYEDEDTYTCDAFDDKSSAHFFVEEQSISIVKELCDEDVTEPEEAKFECEISIPSVKPPKWYLRGEVLQAGRNIIMQQEGTIHRLTILKTTTDMTGTIQFSIGKSKSTANLLVRDYHIQITRKLEDKTALERHSVILSCDFRPSPKVVKWFKGHTPIEPSEKYKIKRDKHSAELKILKLKPDDAGVYKCKAGIAETEATLTVEARNVEVTKHLQDVEIEEESSAIFSCELSHDDEDVEWFLNGTLLYTNNYNDIKNVGNCYTLTMKQVKPEDAGTVTMKSDKVSESARLKVIEKPAVFLKSLDDVFGEERGVIKLECEVSKEKVKPVWKKDGVVLTSGNKYELVQSGKTLYLLIHDLEKADAGLYTCDIGTDVAKSKVGVQELNIGITKRLKNTEIQEGEDCTFECILSHESIDDFNWTLNGSRVESGGRFKASNVGRKYTLSIKSVIPADSGEVVFTARGLTSKASLVVKEKPTEVTKQLEDKTSAAGQDISLSCELSKPDVNIRWYKDGKAIRKSQKYDLQQEGTRAILIIHDSTVKDSGEYTCETEDSKTKARVTVQEKPNYFIKELSDLKIEESGTAVFICQSEKAASSVIWRKGIAELRPGRKYEMTQKGQDLQLTIKNLEKSDSDTYTCDIGDAQSRAKLVVQGQKVLITEDLEDVTVLEGESAMFKCRISPVEYSKVQWFLDKTPLHTNELNDIQSQPGGYHLLTLKKLSLKDSGVITFEAGDKKTSASLVVKEKPCIFTKELVDTEVTEGEDVILHCETSKSDSPVKWCKDGKSLRNSSKYNISRSGFEAKLVIYGAEERDSGRYECEAGAAKSSAVITVKAISALIEEELKNLEAPEGGTATLHCQLSREAPVEWRKGHTVLRPSNKYRMRQEGLVAELLIHDLETKDAGDYTCVVGSQKTTATLTVNALPILFQEEMVDKEATEGQAVTLHCKLSKSAPVEWRKGNKVLKPSEKYKIEQEGPFAELVIQDLDSADAGDYSCVCGNQQTTATLTVNVLPILFTKELSNEEAMEGKSVSLRCELNKAAANVEWKKGLKTLKSSDKYKMKREGVTVELLIQNLDMTDAGNYSCVCGDQQTMAVLTVHALPAFFKEGLKNREATDGGTATLRCELSKVGVPVEWKKGDKTLKSSDKYRMRQEETSAELLIRDLEVEDTGEYTCVCGDQKTSAVLTVHALPVLFKKELVDVEATESGTAVLQCELTKSTPVEWRKGRELLKPSDKYKLRLKDTIAELTIQNLKEEDAGDYTCVCGDKTTTASLTVHALPAHFKEEMKNEEATEGGTATLQCELSRAVPVEWKKKHKVLKSSEKYSMRQEGAIAQLLIHALEVKDAGEYTCVCGDKKTTAVLTVHALPALFREELRDEEATEGDTVTLHCELTKAAPVEWKKGHAVLKPTSEKYIMRQDDVLAELQIRELDLQDAGDYTCVCGDQHTTASLTVNALPAVFKEELKNEEVTEGASVCLHCELSKAAPVQWKIGSKVLEASDKYQMSQPGTTAELVIRDLDITDAGDYTCVCGDQKTTATLTVHDFAALPVTFKQILQNKESEEGSTATFCCELSKPNAAVEWMKGGVGLQPDEKYEMRQRECLVELLIHNLQLEDTGEYSCDTGDQETKASLLVKALPVLFKKELKDEEVEEGAAVKFQCELTKENATVQWRKGTMEIFPCSKYEMKLSGCTAELVIHNAEPEDASDYTCDTGDQQSTAILRVNAIKPQLKQHLKNEEVEVGGTAKLRCEISISKAEVEWRKDGVILHSSSKYEMWQQGTIRELRVHHLEPGDAGEYSCKAGDETTSAKLTVKEPDVTIVSRLKDMVVFEGDDVTFQCQVSHENARDVEWKLQDVALQNNEMNEISVEKGKIHKLTLRKVTEQDTGTITFRVGPYTSTAELTVKEPAATIVEMLKDVTSYEGEDAVFECRLSQETTQDTQWFLGDVPLQSNEMNEIKVEGTRHTLILRKVTLEDCGPISFKVGQHTTGAQLTVQAKNSIVQGLENVEAVEGGEALFECYLSKPECYNYNWLIDDEPAKTTENTEMVYFENGRRHLLLLKNLTLQDNCRVTFMCSDAVTSAFLTVKGWRLQILQPLTDVEVSPGQKATFSCTLSEAVPINEVTWYFNDTEIQPDEDWEIQADGNKYKLILNKAQPHHSGEVTFASREAIASAKLSVLAQPDPPEEPKVLCTSSHSVTLSWYKPLSDGGCNILGYQVERKIPGVGWQSCSESTIQSMEFVVDNLTPGEPYRFRVSAVNKVGASEPAQFPQMVQLVTEPSITVTHPLVGGSVSEGEVARLECKLSSEIKENVTWLKGKEPIQTGGRYEILSDGKKQILIIHAFKAEDQDTYTCMVSPEQMCEELKTCCLALFYEELVDGHVQPSLPPEAAQEGDLHLLWEALAKKRRMSREPTLDSISEVPEEDEKLQKLRKEEAEMSHYYSEEYSTCDELARTGEADFSFTSSDDESRAGTPSLVNYLKKAEKRSVSVTTKVQSTSTGKLWKQWEKSSAETVVAAPGAKPTEPEIADLDDPSMNNAAVKIQAAFKGYKVRKEIKQQECPVFTETFKDFSGEPGSTLHLECVAHSKTDMKVRWLKDGEELSDGRYYHIDNYSDGTCSLIITGLDRKDAGKYTCEASNKFGKVSHSAKVVIGAEEPQTESSSGSELDDAFRKAGRRLHRLFRAKISTEMSDVEEELFVSADEGDVEVVDHQTYREDDRYIYIKFEVLSEAKTAATRFREMFGALGIPVEIDILEQGPRKVELRIGKATPPTLGKFAPPVLRPPPPLLTSDTAPMFLTELQNQEVQDGYPVSFDCIVVGKPLPTVRWFKDGKAIEENDHYMINEDQEGCHQLIITAVVPTDMGVYRCLAENNMGVASTKAELRVDLTSTDYETAADATETSSYYSAKEYVSSREQEESTTEEEQLPQILDDLHDIHVAPGAPLAKFHLKVKGYPEPRLYWFKNGQPLKASDRILKIDKKEFHSLEILNVIKSDAGQYSIFLINSAGSAYSSARLVVKDPDEKEEVSETDSHEQLIPPRFLERFTNKKVKKGASITLSVKVEGHPPPTITWLKEESQEDILWIKPDTPGYKLASSNMHHSLILLDVKKNYSGAYTCIATNKAGQSICTANLEVADVKEAEVLTQERVMVSEAIMTTLGSKTERIISSQLSRKVVTRDLEAGREGVPRTPISLADVGTEEFFQKLTSRISEMVSAKISQATLRVPGAESDDESKTPSASPRHGRSRPSSIAQESSSESDDGDSRGEIFDVYMVTADYVPAAPDKETITLKEGQYVEVLDSAHPLKWLVRTKPTKSSPSRQGWVSPAYLDKRLKLSPEWGTVEVPEFPGECVSEDEYKRKLSVLIQELLISEEDYVQDLQFLQTHHLRYTETCPNVPGAIASQKSTIFRNIDDITRFHSSIFLRGLQKCDTDDDVAMCFIKHEAEFNKYIQYLVGRVQAESIVVSKAVQDFYKRYTDEILTNEDPSQTLIPPLQHYLEKPINRIQQYQTIIKELIRNKARNSQNCTLLEQAYAIVSALTRRAENNLHVSLIENYPGALESLGEPIRQGHFVVWEGAPGARMAWKGHKRHVFLFRNYLVICKPKRDTRTDTYSYIFKNIMKLNNIDVNDIVEGDDRAFEIWHEREDSVRKYLLQARTVNIKNSWVKEICGIQQRISQPVWIPPDFEEELADCTAELGETVKLACKVTGAPKPSVCWYKDGKPVEVDPHHIIIEDPDGSCTLILDNLTGVDSGQYMCFASSPAGNASTLGKILVQVPPRFVNKVRNAYFVEGEDAQFTCTVEGAPRPQIRWYKDGILLKDTNKYQTFSEPRSGIIVLVVKNPSNEDMGHYECELVNRLGSAKSGAELYHHSAAALTQERRGDQAITIEVTEQETKVPKKTIIIEETITTVVKSPRQRGRVSPARSSSGHSPSLSPRAEPTPEPVFVSKIRQPVHRHEQEAASKSAVPMLYVTEPEDRQGAAAREITVETKMEEQKPKWVEVEEIIEFKVKKSPKPARKRGSSPVKQEKDDSGVLTFTFPSSRPTRSPEDDPNTNNSNNKLVEQSKSSLPQESLSEVNIQPLVYATDQEGPQGSNEDRSSPCESEQETKEENVIIIDEPEELQAEDISTRNLKILTHNGKMLTLEDLEDYVPGEGETYGCDDKNHKTDKPCEISVLQTEIREPTIGKPVLLNLGSTLEEHIPGSVFVSTSRVTGVQSVGSSNISIHVSDACMEVKPGVHAAASSAPSFTVKPSFCTEVQLSADNGQSSFKTEVSTRTLSYGTVGEPVTLHISTEDLSQS

SEQ ID NO: 1664 - protein, 168 aa, Gallus gallus
MAPKKAKRRAAEGSSNVFSMFDQTQIQEFKEAFTVIDQNRDGIIDKDDLRETFAAMGRLNVKNEELDAMIKEASGPINFTVFLTMFGEKLKGADPEDVIMGAFKVLDPDGKGSIKKSFLEELLTTQCDRFTPEEIKNMWAAFPPDVAGNVDYKNICYVITHGEDKEGE

SEQ ID NO: 1665 - protein, 553 aa, Gallus gallus
MPLSADPHFKKLLEWHKANASKLVLRQLFEADKDRFHKFSLTLNTDHGDILLDYSKNLVTEEVMKMLIELAKSRGVESARERMFSGEKINFTENRAVLHIALRNRSNTPILVDGKDVVPEVNKVLDKMKHFCQKVRSGEWKGYTGKAITDVVNIGIGGSDLGPLMVTEALKPYSKGGPRVWFVSNIDGTHIAKTLAELHPETTLFIIASKTFTTQETITNAVTAKEWFLHAAKDPSAVAKHFVALSTNGPKVKEFGIDTENMFEFWDWVGGRYSLWSAIGLSIALHIGFDNFESLLAGGHWMDKHFHTAPLEKNVPVLLAMLGVWYINCYGCETHALLPYDQYMHRFAAYFQQGDMESNGKYITKKGSRVDYNTGPIVWGEPGTNGQHAFYQLIHQGTRMIPCDFMIPVQTQHPVRNGLHHKILLANFLAQTEALMKGKTADEARKELQAAGLSGDALEKLLPHKVFEGNRPTNSIMFTKLNPFTLGAIIAMYEHKIFVQGVVWDINSYDQWGVELGKQLAKKIEPELESDAPVTSHDSSTNGLISFIKKHRA

SEQ ID NO: 1666 - protein, 194 aa, Gallus gallus; identical to SEQ ID NO: 873

SEQ ID NO: 1667 - protein, 183 aa, Gallus gallus; identical to SEQ ID NO: 520

SEQ ID NO: 1668 - protein, 419 aa, Gallus gallus
MAGTFGRLLAGRVTAALFAAAGSGVLTTGYLLNQQNVKATVHEKRKLFPPSADYPDLRKHNNCMAECLTPAIYAKLRDKLTPNGYSLDQCIQTGVDNPGHPFIKTVGMVAGDEESYEVFAEIFDPVIKARHNGYDPRTMKHHTDLDASKITHGQFDERYVLSSRVRTGRSIRGLSLPPACSRAERREVENVVVTALAGLKGDLSGKYYSLTNMSERDQQQLIDDHFLFDKPVSPLLTCAGMARDWPDARGIWHNNDKTFLVWINEEDHTRVISMEKGGNMKRVFERFCRGLKEVERLIKERGWEFMWNERLGYVLTCPSNLGTGLRAGVHVKLPRLSKDPRFPKILENLRLQKRGTGGVDTAAVADVYDISNLDRMGRSEVELVQIVIDGVNYLVDCEKKLEKGQDIKVPPPLPQFGRK

SEQ ID NO: 1669 - protein, 634 aa, Gallus gallus
MSGKGPAIGIDLGTTYSCVGVFQHGKVEIIANDQGNRTTPSYVAFTDTERLIGDAAKNQVAMNPTNTIFDAKRLIGRKYDDPTVQSDMKHWPFRVVNEGGKPKVQVEYKGEMKTFFPEEISSMVLTKMKEIAEAYLGKKVETAVITVPAYFNDSQRQATKDAGTITGLNVMRIINEPTAAAIAYGLDKKGTRAGEKNVLIFDLGGGTFDVSILTIEDGIFEVKSTAGDTHLGGEDFDNRMVNRFVEEFKGKHKRDNAGNKRAVRRLRTACERARRTLSSSTQASIEIDSLFEGIDFYTSITRARFEELNADLFRGTLEPVEKALRDAKLDKGQIQEIVLVGGSTRIPKIQKLLQDFFNGKELNKSINPDEAVAYGAAVQAAILMGDKSENVQDLLLLDVTPLSLGIETAGGVMTALIKRNTTIPTKQTQTFTTYSDNQSSVLVQVYEGERAMTKDNNLLGKFDLTGIPPAPRGVPQIEVTFDIDANGILNVSAVDKSTGKENKITITNDKGRLSKDDIDRMVQEAEKYKAEDEANRDRVGAKNSLESYTYNMKQTVEDEKLKGKISDQDKQKVLDKCQEVISSLDRNQMAEKEEYEHKQKELEKLCNPIVTKLYQGAGGAGAGGSGGPTIEEVD

SEQ ID NO: 1670 - protein, 1453 aa, Gallus gallus
MFSFVDSRLLLLIAATVLLTRGEGEEDIQTGSCVQDGLTYNDKDVWKPEPCQICVCDSGNILCDEVICEDTSDCPNAEIPFGECCPICPDVDASPVYPESAGVEGPKGDTGPRGDRGLPGPPGRDGIPGQPGLPGPPGPPGPPGLGGNFAPQMSYGYDEKSAGVAVPGPMGPAGPRGLPGPPGAPGPQGFQGPPGEPGEPGASGPMGPRGPAGPPGKNGDDGEAGKPGRPGQRGPPGPQGARGLPGTAGLPGMKGHRGFSGLDGAKGQPGPAGPKGEPGSPGENGAPGQMGPRGLPGERGRPGPSGPAGARGNDGAPGAAGPPGPTGPAGPPGFPGAAGAKGETGPQGARGSEGPQGSRGEPGPPGPAGAAGPAGNPGADGQPGAKGATGAPGIAGAPGFPGARGPSGPQGPSGAPGPKGNSGEPGAPGNKGDTGAKGEPGPAGVQGPPGPAGEEGKRGARGEPGPAGLPGPAGERGAPGSRGFPGADGIAGPKGPPGERGSPGAVGPKGSPGEAGRPGEAGLPGAKGLTGSPGSPGPDGKTGPPGPAGQDGRPGPAGPPGARGQAGVMGFPGPKGAAGEPGKPGERGAPGPPGAVGAAGKDGEAGAQGPPGPTGPAGERGEQGPAGAPGFQGLPGPAGPPGEAGKPGEQGVPGNAGAPGPAGARGERGFPGERGVQGPPGPQGPRGANGAPGNDGAKGDAGAPGAPGNEGPPGLEGMPGERGAAGLPGAKGDRGDPGPKGADGAPGKDGLRGLTGPIGPPGPAGAPGDKGEAGPPGPAGPTGARGAPGDRGEPGPPGPAGFAGPPGADGQPGAKGETGDAGAKGDAGPPGPAGPTGAPGPAGZVGAPGPKGARGSAGPPGATGFPGAAGRVGPPGPSGNIGLPGPPGPAGKZGSKGPRGETGPAGRPGEPGPAGPPGPPGEKGSPGADGPIGAPGTPGPQGIAGQRGVVGLPGQRGERGFPGLPGPSGEPGKQGPSGASGERGPPGPMGPPGLAGPPGEAGREGAPGAEGAPGRDGAAGPKGDRGETGPAGPPGAPGAPGAPGPVGPAGKNGDRGETGPAGPAGPPGPAGARGPAGPQGPRGDKGETGEQGDRGMKGHRGFSGLQGPPGPPGAPGEQGPSGASGPAGPRGPPGSAGAAGKDGLNGLPGPIGPPGPRGRTGEVGPVGPPGPPGPPGPPGPPSGGFDLSFLPQPPQEKAHDGGRYYRADDANVMRDRDLEVDTTLKSLSQQIENIRSPEGTRKNPARTCRDLKMCHGDWKSGEYWIDPNQGCNLDAIKVYCNMETGETCVYPTQATIAQKNWYLSKNPKEKKHVWFGETMSDGFQFEYGGEGSNPADVAIQLTFLRLMSTEATQNVTYHCKNSVAYMDHDTGNLKKALLLQGANEIEIRAEGNSRFTYGVTEDGCTSHTGAWGKTVIEYKTTKTSRLPIIDLAPMDVGAPDQEFGIDIGPVCFL

SEQ ID NO: 1671 - protein, 192 aa, Gallus gallus
MAPKKDVKKPAAAAAPAPAPAPAPAPAPAKPKEPAIDLKSIKIEFSKEQQDDFKEAFLLFDRTGDAKITLSQVGDIVRALGQNPTNAEINKILGNPSKEEMNAKKITFEEFLPMLQAAANNKDQGTFEDFVEGLRVFDKEGNGTVMGAELRHVLATLGEKMTEEEVEELMKGQEDSNGCINYEAFVKHIMSV

SEQ ID NO: 1672 - protein, 254 aa, Gallus gallus
MAAYRLVLVRHGESAWNLENRFCGWYDADLSPAGQQEARRGGEALRDAGYEFDICFTSVQKRAIRTLWNVLDAIDQMWLPVVRTWRLNERHYGALTGLNKAETAAKHGEAQVKIWRRSFDIPPPPMQSDHPFFSTISKDRRYADLTEDQLPTCESLKDTIARALPFWNEEIVPQIKEGKRVLIAAHGNSLRGIVKHLEGMSEEAIMELNLPTGIPIVYELDKNLKPIKPMQFLGDEETVRKAMEAVAAQGKVKK

SEQ ID NO: 1673 - protein, 537 aa, Gallus gallus
MTGKTAPAAAKKAPAAKKAPAPASKKAPEPAPKEKPAPTPKEGHAPTPKEEHAPPPKEEHAPPPKEEHAPAPAAETPPAPEHPPDAEQPAAPAAEHAPTPTHEAAPAHEEGPPPAAPAEAPAPEPEPEKPKEEPPSVPLSLAVEEVTENSVTLTWKAPEHTGKSSLDGYVVEICKDGSTDWTAVNKEPFLSTRYKIHDLASGEKVHVRVKAISASGTSDPATLEQPVLIREITDLPRIRLPRQLRQVYVRHVGEAVNLLIPFQGKPQPQVTWTKDNQPLDTSRVNIRNTDKDTIFFIRTAQRSDSGKYQLSVRINGAEDKAILDIRVIERPGPPQNLKLVDVWGFNVALEWSPPADNGNSEIKGYTVQKSDKKSGKWFTVLERCTRTSCTISDLIIGNTYSFRVFSENACGMSETAAVAAGVAHIKKTVYQPQKIPERDMMEPPKFTQPLTDRATTRGYSTHLFCSVRGFPQPKIIWMKNKMEIREDPKYIAMIEQGVCSLEIRKPSPFDAGVYTCKAVNPLGEASVDCKLDVKMPK

SEQ ID NO: 1674 - protein, 1650 aa, Gallus gallus
MSLPFYQRHHDHYDRAYRHKALQSTVSQYQKESKSKSAVYAQGSAAYARGSAAYRHASAADFSLDSSAAYSHGSSAHNLESAAYSYGSTAYDHAAVQRKLKDSNLMIEDQSYKMSPKAKRAKQTLVSEDKENEAVDYSVPIFTGREVNISGITDTEEERIKESAAYVAKRNLFATGEGVSVSKVAKSVSEEEHHEKKSRKVAIRESAERVALKKTLEDTQAFHKKLNQDKLLHPPEFVIKPRSHTIWEKQNVKFHCTVAGWPAPRVTWYKNNVPIDVQAHPGKYTIENRYGLHSLEISTCDFDDIAQYRASAMNVKGEISAYASLVVKRYKGEIDASYLHAGTFSMPLSLGVTPHGFASRFEIKFVDKFEVTFGREGETMSLGCTVVISPDIKRFKPDIEWYRNGVLITPSKWVQMHWSGERASLTLTHANKEDEGLYTLRVVMGEYYEEYSGYVFVRDADAEIPGAPGAPLDVQCLDANKDYVIVSWKQPAVDGGNPILGYFIDRCEVGTTHWTQCNETPVKFARFPVTGLIEGRSYIFRVRAVNKAGVSLPSRVSEPVAALDPADRARLRSHPSAPWTGQIIVTEEEPAEGVVPGPPTDLQVIEATKNYVVLSWKPPGQRGHEGIMYFVEKCIAGTEDWQRVNTEIPVKSPRFAVFDLSEGKSYCFRVRCCNSAGIGEPSEATEATVVDDKLDIPKPPGRIMPTRNTDTSVVVTWTESPDAKELVGYYIESSVVGSGHWEPCNNNPVKGTRFICHGLVNGEKYIFRVRAVNAAGLSEFSQDSEPIEVQAAIVIGGGLLHGVCPELSGKADGLTDCTTSWEGMHESSQPIFDTDALLKCNAKFNRDPLPSSSDKLGSTGDNNLREMVKDAITSAPQKVVAKQASKSRPGDPLAMEKVETAAPSPPYDITVLESVRDSMVLGWKQPKATGGTEITGYYVNYREVIGGVPGKWMEANIKAVSERAYRIENLKENMVYQFQVAAANLAGVGTPSLPSKPFKCEEWTIAVPGPPHDVTYTEVRKDSLVLLWKEPVYTGRSPIAGYYVDMKETEANEEHWRSVNEKPLQKKFLKIAGLTEGVSYVFRVRATNQAGVGRPSDTTDPVVAETRPGTKEVVVNVDDDGVISLNFECDQMSPNSKFVWSKNYEPIEDDSRLDIDSKGGKSKAVFKDLGEDDLGIYSCVVTDTDGVSSGYTIDEEEMKRLLALSHEHKFPTIPLASELAVEILEKGEVRFWLQAEKLSGNAKANFVFNDKEIFNGEKYKMKVDQHTGLVEMIMDKLEDKDEGTYTFQLQDGKATNQSSLVLIGDVFKKLRDEAEFQRKEWHRKQGPHFVEQLGWEVTDECNVMLKCKVANIKKETHIVWYKDDREIMVDEEHDFKDGVCTLLISEFSKKDTGIYEVILKDDRGKDISELKLTDKAFADLMNEVCRRIALSATDLKIQSTAEGIRLYSFVTYYVEDLRVGWVHNDTQIRFTDRVKTGVTGEQIWLQINEPTPQDKGKYTMELFDGKTGHKKTVDLSGQAFDEAFAEFQRLKQAAIAEKNRARVLGGLPDVVTIQEGKALNLSCTVWGDPTPEVSWLKNEKSFVSDANCILRFESGKNVSFTISAVSTLDSGKYSLVVKNKYGTETSDVTVSVFIPEEEQEKNNEDKKTKA

SEQ ID NO: 1675 - protein, 434 aa, Gallus gallus
MSILKIHAREIFDSRGNPTVEVDLYTNKGLFRAAVPSGASTGIYEALELRDNDKTRYLGKGVSKAVEHVNKTIAPALISKNVNVVEQEKIDKLMLEMDGTENKSKFGANAILGVSLAVCKAGAAEKGVPLYRHIADLAGNPEVILPVPAFNVINGGSHAGNKLAMQEFMILPVGADTFKEAMRIGAEVYHNLKNVIKEKYGKDATNVGDEGGFAPNILENKEALELLKTAIGKAGYSDKVVIGMDVAASEFYRDGKYDLDFKSPDDPSRYISPDQLADLYLGFVKNYPVVSIEDPFDQDDWAAWKKFTASVGIQVVGDDLTVTNPKRIAKAVEEKSCNCLLLKVNQIGSVTESLQACKLAQSNGWGVMVSHRSGETEDTFIADLVVGLCTGQIKTGAPCRSERLAKYNQLLRIEEELGSKARFAGRNFRNPRIN

SEQ ID NO: 1676 - protein, 646 aa, Gallus gallus
MSKGPAVGIDLGTTYSCVGVFQHGKVEIIANDQGNRTTPSYVAFTDTERLIGDAAKNQVAMNPTNTVFDAKRLIGRRFDDSVVQSDMKHWPFTVVNDAGRPKVQVEYKGETKSFYPEEISSMVLTKMKEIAEAYLGKTVTNAVVTVPAYFNDSQRQGTKDAGTIAGLNVLRIINEPTAAAIAYGLDKKVGAERNLLIFDLGGGTFDVSILTIENGIFEVKSTAGDTHLGGEDFDNRLVNHFIAEFKRKHKKDISENKRAVRRLRTACERAKRTLSSSTQASIEIDSLYEGIDFYTSITRARFEKLNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLDSYAFNMKATVEDEKLPGKILDEDHQNILDKCNEIINWLDKNQTAEKEEFEHQQKELEKVCNPIITKLYQSAGGMPGGMPGGFPGGGAPPSGGASSGPTIEEVD

SEQ ID NO: 1677 - protein, 3137 aa, Gallus gallus
MRKHRHLPLAAILGLLLSGFCSVGAQQQAAVRNVAVADIIFLVDSSWSIGKEHFQLVREFLYDVVKALDVGGNDFRFALVQFSGNPHTEFQLNTYPSNQDVLSHIANMPYMGGGSKTGKGLEYLIENHLTKAAGSRASEGVPQVIIVLTDGQSQDDVALPSSVLKSAHVNMIAVGVQDAVEGELKEIASRPFDTHLFNLENFTALHGIVGDLVASVRTSMTPEQAGAKGLVKDITAQESADLIFLIDGSDNIGSVNFQAIRDFLVNLIESLRVGAQQIHIGVVQYSDQPRTEFALNSYSTKADVLDAVKALSFRGGKEANTGAALEYVVENLFTQAGGSRIEEAVPQILVLISGGESSDDIREGLLAVKQASIFSFSIGVLNADSAELQQIATDGSFAFTALDIRNLAALRELLLPNIVGVAQRLILLEAPTIVTEVIEVNKKDIVFLIDGSTALGTGPFNSIRDFVAKIVQRLEVGPDLIQVAVAQYADTVRPEFYFNTHQNRKDVMANVKKMKLMGGTALNTGSALDFVRNNFFTSAAGCRMEEGVLPMLVLITGGKSMDAVEQAAAEMKRNRIVILAVGSRNADVAELQEIAHERDFVFQPNDFRLQFMQAILPEVLSPIRTLSGGMVIHETPSVQVTKRDIIFLLDGSLNVGNANFPFVRDFVVTLVNYLDVGTDKIRVGLVQFSDTPKTEFSLYSYQTKSDIIQRLGQLRPKGGSVLNTGSALNFVLSNHFTEAGGSRINEQVPQVLVLVTAGRSAVPFLQVSNDLARAGVLTFAVGVRNADKAELEQIAFNPKMVYFMDDFSDLTTLPQELKKPITTIVSGGVEEVPLAPTESKKDILFLIDGSANLLGSFPAVRDFIHKVISDLNVGPDATRVAVAQFSDNIQIEFDFAELPSKQDMLLKVKRMRLKTGKQLNIGVALDEVMRRLFVKEAGSRIEEGIPQFLVLLAAGRSTDEVERPSGALKEAGVVTFAIKAKNADLSELERIAYAPQFILNVESLPRISELQANIVNLLKTIQFQPTVVERGEKKDVVFLIDGSDGVRRGFPLLKTFVERVVESLDIGRDKVRVAIVQYSNAIQPEFLLDAYEDKADLVSAIQALTIMGGSPLNTGAALDYLIKNVFTVSSGSRIAEGVPQFLILLTADRSQDDVRRPSVVLKTSGTVPFGIGIGNADLTELQTISFLPDFAISVPDFSQLDSVQQAVSNRVIRLTKKEIESLAPDLVFTSPSPVGVKRDVVFLVDGSRYAAQEFYLIRDLIERIVNNLDVGFDTTRISVVQFSEHPHVEFLLNAHSTKDEVQGAVRRLRPRGGQQVNVGEALEFVAKTIFTRPSGSRIEEGVPQFLVILSSRKSDDDLEFPSVQVKQVGVAPMVIAKNMDPEEMVQISLSPDYVFQVSSFQELPSLEQKLLAPIETLTADQIRQLLGDVTTIPDVSGEEKDVVFLIDSSDSVRSDGLAHIRDFISRIVQQLDVGPNKVRIGVVQFSNNVFPEFYLRTHKSKNAVLQAIRRLRLRGGYPVNAGKALDYVVKNYFIKSAGSRIEDGVPQHLVVILGDQSQDDVNRPANVISSTSIQPLGVGARNVDRNQLQVITNDPGRVLVVQDFTGLPTLERKVQNILEELTVPTTEGPVYPGPEGKKQADIVFLLDGSINLGRDNFQEVLQFVYSIVDAIYEDGDSIQVGLAQYNSDVTDEFFLKDYSSKPEILDAINKVIYKGGRVANTGAAIKHLQAKHFVKEAGSRIDQRVPQIAFIITGGKSSDDGQGASMEVAQKGVKVFAVGVRNIDLEEVSKLASESATSFRVSTAQELSELNEQVLVTLAAAMKEKLCPGTTDVTRDCDLDVILGFDVSDVGAGQNIFNSQRGLESRVEAVLNRITQMQKISCTGSRAPSVRVAIMAQSRGGPVEGLDFSEYQPELFERFQGMRTRGPYFLTAETLKSYQNKFRSAPSGSTKVVIHFTDGTDDYLDQMKTASADLRRQGVHALLFVGLDRVKNFEEVMQLEFGRGFTYNRPLRVNLLDLDFELAEQLDNIAERTCCGVPCKCSGQRGDRGLPGPIGPKGATGEIGYGGYPGDEGGPGERGPPGVNGTQGFQGCPGHRGTKGSRGFPGEKGELGEMGLDGIDGEEGDKGLPGFSGEKGFSGRRGSKGAKGERGERGDRGLRGDPGESGADNTQRGTRGQKGEIGQMGEPGPAGQRGQDGGVGRKGMAGRRGPIGVKGTKGALGQPGPAGEQGMRGPQGPPGQIGTPGIRGEQGIPGPRAGGGQPGAPGERGRIGPLGRKGEPGNPGPRGPNGQQGPRGEMGDDGRDGIGGPGPKGRKGERGFVGYPGPKGGPGDRGGAGGPGPKGNRGRRGNAGNPGTPGQKGEIGYPGPSGLKGDKGPSISQCALVQNIKDKCPCCYGPKECPVFPTELAFAIDTSSGVGRDVFNRMKQTVLRVVSNLTIAESNCPRGARVALVTYNNEVTTEIRFADARKKSSLLQQIQNFQATLTTKPRSLETAMSFVARNTFKRARSGFLMRKVAVFFSNGETRASPQLNDAVLKLYDAGVTPVFLTSRQDAVLERALEINNTAVGHAIVLPTSGSQLNDTIRRLLTCHVCLDVCEPDPICGYGSQRPVFRDRRAAPTDVDTDIAFIMDSSASTTPLQFNEMKKYISHLVSNMEISSEPKISQHHARVAVLQQAPYDHETNSSFPPVKTEFSLTDYGSKEKIINYLHNQMTQLYGTMAMGSAVEHTVAHVFESAPNPRDLKVIVLMITGKMEKQELEYLREAVIDAKCKGYLFVILGIGKNVDVKNIYSLASEPNDVFFKLVSKPGELHEEPLLRFGRLLPSFIRSDFAFYLSPEIRKQCKWLQADQTPKSPGHTGQKAVYIAPNGTVTQTISTTTTLSTTFKPAASTSAHAKTTTASTTAQTRATERPTESTTVQVNATVQSQGSTAANTKATSRTTTSTTAAAASGRRRQGAKMNDIQITDVTENSARLRWASPEPHNAYVFDLAITLAHDHSLVLKQNVTGTERVIGGLRSGQKYLVFITGYLKSQPKVTYTGTFSTKTPAQPKVALANMMLNAEPLEGPENVMDICLLQKEEGTCRDFVLKWHYDLKTKSCARFWYGGCGGNENRFNTQKECEKACSPGNISPGVVTTIGT

SEQ ID NO: 1678 - protein, 1318 aa, Gallus gallus
GPPGPPGRDGEDGPPGPPGPPGPPGLGGNFAAQYDPSKAADFGPGPMGLMGPRGPPGASGPPGPPGFQGVPGEPGEPGQTGPQGPRGPPGPPGKAGEDGHPGKPGRPGERGVAGPQGARGFPGTPGLPGFKGIRGHNGLDGQKGQPGTPGTKGEPGAPGENGTPGQPGARGLPGERGRIGAPGPAGARGSDGSAGPTGPAGPIGAAGPPGFPGAPGAKGEIGPAGNVGPTGPAGPRGEIGLPGSSGPVGPPGNPGANGLPGAKGAAGLPGVAGAPGLPGPRGIPGPPGPAGPSGARGLVGEPGPAGAKGESGNKGEPGAAGPPGPPGPSGEEGKRGSNGEPGSAGPPGPAGLRGVPGSRGLPGADGRAGVMGPAGNRGASGPVGAKGPNGDAGRPGEPGLMGPRGLPGQPGSPGPAGKEGPVGFPGADGRVGPIGPAGNRGEPGNIGFPGPKGPTGEPGKPGEKGNVGLAGPRGAPGPEGNNGAQGPPGVTGNQGAKGETGPAGPPGFQGLPGPSGPAGEAGKPGERGLHGEFGVPGPAGPRGERGLPGESGAVGPAGPIGSRGPSGPPGPDGNKGEPGNVGPAGAPGPAGPGGIPGERGVAGVPGGKGEKGAPGLRGDTGATGRDGARGLPGAIGAPGPAGGAGDRGEGGPAGPAGPAGARGIPGERGEPGPVGPSGFAGPPGAAGQPGAKGERGPKGPKGETGPTGAIGPIGASGPPGPVGAAGPAGPRGDAGPPGMTGFPGAAGRVGPPGPAGITGPPGPPGPAGKDGPRGLRGDVGPVGRTGEQGIAGPPGFAGEKGPSGEAGAAGPPGTPGPQGILGAPGILGLPGSRGERGLPGIAGATGEPGPLGVSGPPGARGPSGPVGSPGPNGAPGEAGRDGNPGNDGPPGRDGAPGFKGERGAPGNPGPSGALGAPGPHGQVGPSGKPGNRGDPGPVGPVGPAGAFGPRGLAGPQGPRGEKGEPGDKGHRGLPGLKGHNGLQGLPGLAGQHGDQGPPGNNGPAGPRGPPGPSGPPGKDGRNGLPGPIGPAGVRGSHGSQGPAGPPGPPGPPGPPGPNGGGYEVGFDAEYYRADQPSLRPKDYEVDATLKTLNNQIETLLTPEGSKKNPARTCRDLRLSHPEWSSGFYWIDPNQGCTADAIRAYCDFATGETCIHASLEDIPTKTWYVSKNPKDKKHIWFGETINGGTQFEYNGEGVTTKDMATQLAFMRLLANHASQNITYHCKNSIAYMDEETGNLKKAVILQGSNDVELRAEGNSRFTFSVLVDGCSKKNNKWGKTIIEYRTNKPSRLPILDIAPLDIGGADQEFGLHIGPVCFK

SEQ ID NO: 1679 - protein, 277 aa, Gallus gallus
EAHEAEEVHEEAHHEEAHHEEAHHEEAHHAEAHHAEAHHEEAHAHAEEVHEPAPPPVHEPDILLTAPKIPEGEKVDFDDIQKKRQNKDLIELQALIDSHFEARRKEEEELVALKERIEKRRAERAEQQRIRAEKEKERQARLAEEKARREEEDAKRKAEDDLKKKKALSSMGASYSSYLAKADQKRGKKQTARETKKKVLAERRKPLNIDHLNEDKLRDKAKELWDWLYQLQTEKYDFAEQIKRKKYEILTLRCRLQELSKFSKKAGAKGKVGGRWK

SEQ ID NO: 1680 - protein, 137 aa, Gallus gallus
LLKPNMVTPGHSCPTKYSPEEIAMATVTALRRTVPPAVPGVTFLSGGQSEEEASINLNAINTCPLVRPWALTFSYGRALQASALSAWRGQRDNANAATEEFVKRAEVNGLAALGKYEGSGDDSGAAGQSLYVANHAY

SEQ ID NO: 1681 - protein, 298 aa, Gallus gallus
MSDQALSFLKDFLAGGVAAAISKTAVAPIERVKLLLQVQHASKQITAEKQYKGIIDCVVRIPKEQGIISFWRGNLANVIRYFPTQALNFAFKDKYKQIFLGGVDRHKQFWRYFAGNLASGGAAGATSLCFVYPLDFARTRLAADVGKGVSEREFTGLGDCIVKIFKSDGLRGLYQGFNVSVQGIIIYRAAYFGVYDTAKGMLPDPKNVHIIVSWMIAQSVTAAAGLVSYPFDTVRRRMMMQSGRKGADIMYKGTIDCWKKIAKDEGSKAFFKGAWSNVLRGMGGAFVLVLYDEIKKYV

SEQ ID NO: 1682 - protein, 406 aa, Gallus gallus
MKATCWILAGFCLLFCCKAEEGLNFPTYDGKDRVIDLNEKNYKHALKKYDMLCLLFHEPVSSDRVSQKQFQMTEMVLELAAQVLEPRSIGFGMVDSKKDAKLAKKLGLVEEGSLYVFKEERLIEFDGELATDVLVEFLLDLLEDPVEVINSKLELQAFDQIDDEIKLIGYFKGEDSEHYKAFEEAAEHFQPYVKFFATFDKGVAKKLGLKMNEVDFYEPFMDEPVHIPDKPYTEEELVEFVKEHKRATLRKLRPEDMFETWEDDMEGIHIVAFAEEDDPDGFEFLEILKQVARDNTDNPDLSIVWIDPDDFPLLITYWEKTFKIDLFRPQIGIVNVTDADSVWMEIRDDDDLPTAEELEDWIEDVLSGKINTEDDDDDDDDDDDDDDDDDDDDDDDDDDDDDDDDD

SEQ ID NO: 1683 - protein, 466 aa, Gallus gallus
PTSMGKEKTHINIVVIGHVDSGKSTTTGHLIYKCGGIDKRTIEKFEKEAAEMGKGSFKYAWVLDKLKAERERGITIDISLWKFETTKYYITIIDAPGHRDFIKNMITGTSQADCAVLIVAAGVGEFEAGISKNGQTREHALLAYTLGVKQLIVGINKMDSTEPAYSEKRYDEIVKEVSAYIKKIGYNPATVPFVPISGWHGDNMLEPSPNMPWFKGWKVERKEGNASGVSLLEALDTILPPTRPTDKPLRLPLQDVYKIGGIGTVPVGRVETGILRPGMVVTFAPVNITTEVKSVEMHHEALSEALPGDNVGFNVKNVSVKDIRRGNVCGDSKSDPPQEAAQFTSQVIILNHPGQISAGYSPVIDCHTAHIACKFAELKEKIDRRSGKKLEDNPKSLKSGDAAIVEMIPGKPMCVESFSQYPPLGRFAVRDMRQTVAVGVIKNVEKKSGGAGKVTKSAQKAQKAGK

SEQ ID NO: 1684 - protein, 472 aa, Gallus gallus
  MOD_RES (93)..(96): Any amino acid
MKRLNLLCCCVASLLLLGTAEEVEDASEPTKRDRSHLENTLKLNEDKPADDFSGVLQRLRKIYHASIKPLEQSYRYNELRQHEITADGAIPGXXXXMVLFLGPWSVGKPSMINYLLGLDDTPYQLYTGAEPTTSEFTVIMHGPKLKTIEGIVMAADSARSFSPLEKFGQNFLEKLIGIEVPHKLLERVTFVDTPGIIENRKQQERGRGLQEGCYYMLQQGSVPTLKEFPPPSDLNFTSFNSFYNLPLNTRNPLRGLPGGKGLASQEALKCFSTYETVSVLYENQQSPLIRRESPLPRWPFLLDFSFLSPRLPVQRYLNQVIENRMENKIAFIRQHAIRVRIHALLVDRYLQTYKDKMTFFSDGELVFRDIVEDPDKFFIFKSILAKTNVSKFDLPNREAYKDFFGINPITSFKLLSQQCSYMGGCYLEKIEKAITRELPDLLGSIGLGKKPNVLSCDVTGCGETPKNRYKKP

SEQ ID NO: 1685 - protein, 340 aa, Gallus gallus
MSEKTPFETDMLTLTRFVMEKGRRVKGATGELTQLLNSMLTAIKAISSAVRKAGLAHMFGIAGTVNVTGDEVKKLDVLSNSLVINMLQSSYSTCVLVTEENKEALITPKEKRGKYVVCFDPLDGSSNIDCLAPIGTIFAIYKKETDDEPSEKDALQPGRKIVAAGYALYGSATLVALSTGQGVDCFMLDPALGEFILVDRDVKIKKKGKIYSLNEGYAKYFDPAMTEYLKKKKFPEDGSSPYGARYVGSMVADVHRTLMYGGIFMYPANQKSPKGKLRLLYEGNPMAFIIEQAGGIATTGTEAVLDVKPEGIHQRVPLILGSPDDVHEYLACVQKHQKSS

SEQ ID NO: 1686 - protein, 463 aa, Gallus gallus
SQSYSSSQRVSSYRRTFGGGTSPVFPRASFGSRGSGSSVTSRVYQVSRTSAVPTLSTFRTTRVTPLRTYGSAYQGAGELLDFSLADAMNQEFLQTRTNEKVELQELNDRFANYIEKVRFLEQQNALMVAEVNRLRGKQPTRVAEMYEEELRELRRQVDALTGQRARVEVERDNLLDNLQKLKQKLQEEIQLKQEAENNLAAFRADVDAATLARIDLERRIESLQEEIAFLKKVHEEEIRELQAQLQEQHIQVEMDISKPDLTAALRDIRAQYESIAAKNIAEAEEWYKSKVSDLTQAANKNNDALRQAKQEMLEYRHQIQSYTCEIDALKGTNDSLMRQMREMEERFAGEAGGYQDTIARLEEEIRHLKDEMARHLREYQDLLNVKMALDVEIATYRKLLEGEENRISIPMHQTFASALNFRETSPDQRGSEVHTKKTVMIKTIETRDGEVVSEATQQQHEVL

SEQ ID NO: 1687 - protein, 4861 aa, Gallus gallus
DDEVVLQCVSSIHKEQRKFCLAAEGLGNRLCFLEPTSEAKYVPPDLCICNFVLEQSLSVRALQEMLTNTGDNASEGAAQGGHRTLLYGHAILLRHSFSEMYLTCLTSSRSQTDKLAFDVGLRENAAGEACWWTIHPASKQRSEGEKVRIGDDLILVSVSSERYLHLSMSNGSIQVDASFMQTLWNVHPTCSGSNITEGYLLGGHVVRFFHGHDECLTIPSTDQNDSQQKKVLYETGGAGVRARSLWRVEPLRISWSGSNIRWGQPFRLRHITTGMYLALNDDEGLVMLDREKSDTTSSAFCFRASKELKEKQDSTLKRDIDGMGVPEIKYGDSVCFIQHVASALWLTYKAPDAKSARLGLLKRKVILHQEGHMDDGLTLQRCQHEESQAARIIRNTTSLFSQFINNIFCLFGNNRTLSPIALPVEEMAQTLQDLIKYFQPPGEDLEHEDKQNKLRSLKNRQNLFKDEGMLALVLNCIDRLNDYNSAAHFAEISRVENGTAWKEILNLLYELLAALIRGNRNNCTQFSSNLDWLISKLDRLESSSGILEVLHCILIESPEALNVIAEEHIKSIISLLDKHGRNYKVLDVLCSLCVCNGVAVRANQNLICDNLLPRRDLLLQTRLINDVTSIRPNIFLGVAEGSAQYKKWYFELIIDQVDPFLTAEPTHLRVGWASTSGYAPYPGGGEGWGGNGVGDDLYSFGFDGLHLWSGRVPRAVASVNQHLLSSDDVVSCCLDLGVPSISFRINGQPVQGMFENFCTEGFFFPVVSLSAGVKARFLLGGRHGEFKFLPPTGYAPCYEALLPKEKMKLEPVKEYKRDSDGVRDLLGTTQFLSQASFIPCPIDTSQIALPFHLEKIRDKLAENIHELWGMNKIELGWTYGKIRDDNKRHHPCLVEFSKLPETEKNYNLQMSTETLKTLLALGCHIVHANPAAEEDLKKVKLPKNYIMSNGYKPAPLDLSEVKLLPSQEFLVDKLAENAHNVWAKDRIKQGWTYGIQQDLKNKRNPRLVPYALLDERTKKSNRDSLREAVRTFAGYGYNVEPPDQEIADQTVEKVSIDKIRFFRVEQSYAVKSGKWYFEFEAVTGGDMRVGWARPGCRPDIELGADDQAFVFEGSKGQRWHQGSGFFGRSWQPGDVVGCMINLDDKSIIFTLNGELLITSKGSELAFADFGIESGFVPICSLGLSQIGRMNLGMDASTFKYYTMCGLQEGFEPFAVNMNRDVAMWFSKRLPTFVNVPKNHPHIEIWRIDGTIESPPRLKVTHKTFGTQNSNSDMIYCRLSMPIEFRSSFNFGVGVENASSDALQKRKHSQEFPASSTTCFYSLRIFAGQDPSSVWVGWVTPDYHFYSENFDINKNCTVTVTLGDERGRVHESVKRSNCYMVWGGDIAANSQRSGRSNVDLEIGCFVDLATGMLSFTANGKELGTCYQVEPNTKLFPAAFVQPTSTNLIQFELGKLKNTMPLSAAIFKSEERNPVPQCPPRLDVQTITPVLWSRMPNSFLKVETERVSERHGWVVQCLEPLQMMALHIPEENRCVDILELCEQEDLMKFHYHTLKLYSSVCALGNTRVAYALCSHVDISQLFYTIDNQYLPGLLRSGFYDLLISIHLDHAKQAKLMMNNEFIIPVTEETRTIKLYPDETKKHGLPGVGLSTCLKPSFNFSTPCFIVTSEEHQTSSPDIPLDTLKSKAISMLTEAVQCSGSHIRDPVGGHIAFQFVPVLKLIATLLVMGVFDDDDVKQVLILIDPNVFGDHKEEAEEKTEKEEVTQVEEKAVEAGEKAVKETKAPTKGLLQTRLPESVKLQMCHLLNYFCDCELQHRVEAIVSFADHYVSKLQYNQKYRYNELMQALNMSAALTAKKTKEFRSPPQEQINMLLNFQLGEDCPCPEEIRDELYDFHDDLLIHCGIPLEEEEEEEEDSSLTGKLRSLIYKIKGPPKPEKIEPREEEDKSPTTLKELISQTMVRWSQEDQIQDPELVRIMYTLLRRQYDSIGELLQALRKAYTISAASVKDTINLLAALGQIRSLLSVRMGKEEELLMINGLGDIMNNKVFYQHPNLMRVLGMHETVMDVMVNVLGGDKSQQIAFPKMVASCCRFLCYFCRISRQNQKAMFEHLSYLLENSSVGLAFPSMRGSTPLDVAAASVMDNNELALALEEPDLDKVVTYLAGCGLQSCPVLLAKGYPDIGWNPIEGERYLSFLRFAVFVNSESVEENASVVVKLLIRRPECFGPELRGEGGNGLLAAMQEAIRISENPTRDLPSQGYKREGDEEEEEEEEIVHMGNAIMSFYSALIDLLGRCAPEMHLIQSGKGEAIRIRSILRSLVPTEDLVGIISIPLKLSTVNKDGTVNEPDMSANFCPDHKAPMVLFLDRVYGIKDQSFLLHLLEVGFLPDLRASASLDTVSLSTTEAALALNRYICSAVFPLLKRCAPLFSGTEHHASLVDSMLHTIYRLSKGRSLTKAQRDTIEECLLAICHHLRPSMLQQLLRRLVFDVPLLNEYCKMPLKLLTNHYEQCWKYYCLPSGMGSYGIAAEDELHLTEKLFWGIFDSLSHKKYDPELFRMALPCLSAIAGALPPDYLDTRIRSTLEKQTSVDPEGNFDPKPVNTANLVLPEKLEYIVSKYAEHSHDKWAFDKTNNGWKYGVSLDENTKTHPLIRPFKTLTEKEKEIYRWPVRESLKTMLAMGWSLERTKEGGEGMLHQRENEKLRSISQSSQGNGYSPAPLDLTNVVLSRELQGMVEVMAENYHNIWAKKKKMELESKGGGSHPLLVPYDTLTAKEKSRDREKAQELFKFLQVNGIIISRGLNDMDLDASSMEKRFAFKFLKKILKYVDSAQEFIAHLEAIVTSGKTEKSPHDQEIKFFAKVLLPLVDQYFTNHCLYFLSSPTKTLSSSGYASNKEKEMVASLFCKLAALVRHRISIFGSDSTTMVSCLHILAQSLDTRTVMKSGSELVKAGLRAFFENAAEDLEKTSENLKLGKFTHSRTQIKGVSQNINYTTVALLPVLTSIFEHISQYHFGVDLLLGDVQVSCYRILCSLYSLGTGKNIYVERQRPALGECLASLAAAIPVAFLEPSLNHYNPLSVFNTKSARERAILGMPDTVEEMCPEIPQLDGLIKEINNLAESGARYTEMPHVIEVILPMLCNYLSYWWERGSESVPESAGPCCTMITSEHLSIILGNILKIINNNLGIDEASWMKRIAVYAQPIISKARPDLLKTHFIPTLEKLKKKAIKIVMEEEQLRADSKSDTQEAELLILDEFAVLCRDLYAFYPMLIRYVDNNRANWLKKPDADSDELFRMVAEVFILWCKSHNFKREEQNFVIQNEINNLAFLTGDTKSKMSKAMQVKSGGQDQERKKSKRRGDLYSIQTSLIVAALKKMLPIGLNMCTPGDQELISLAKTRYSHRDTDEEVKEHIRNNLHLQEKSDDPAVKWQLNLYKDILKSDEPPDPEKNVERVQRISAALYHLDQVEQPLRSKKAVWHKLLSKQRKRAVVACFRMAPLYNLPRHRSINLFLHGYQNYWIETEEYSFEEKLVQDLATSPKKEEEEEEDTEKEQPDPLHQIILYFSRNALTERSKLEDDPLYIAYAAMMAKSCQEEEEEEEEDKEKTFEEKEMEKQRTLYQQARLHDRGAAEMVLQMISASKGHTGPMVVETLKLGIAILNGGNTIVQQKMLDYLKEKKDAGFFQSLSGLMQSCRSVLDLNAFERQNKAEGLGMVTEEGTLIVRERGEKVLQHDEFTRDLFRFLQLLCEGHNNDFQNYLRTQMGNTTTVNIIISTVDYLLRLQESISDFYWYYSGKDVIDESGQRNFSKALAVTKQIFNSLTEYIQGPCIGNQQSLAHSRLWDAVVGFLHVFANMQMKLSQDSAQIELLKELLDLLKDMVVMLLSLLEGNVVNGTIGKQMVDTLVESSSNVELILKFFDMFLKLKDLTNSDAFKEHDPDGKGIISKKDFQKSMEAQKQYIQSEIEFLLSCAEADENDMFNYIDFVERFHEPAKDIGFNVAVLLTNLSEHMPNDSRLQSLLEPAESVLNYFEPYLGRIEIMGGAKKIERVYFEISESSRMQWEKPQVKESKRQFIFDVVNEGGEQEKMELFVNFCEDTIFEMQLASQISESDSAERPEEEEEEEPCYVVDIGDDEEEEKSLESPSAFALACAAVKKNVANFFKMVTVKNLRKQYRKVRKMTVKEMVKVFFSFFWILFVGVFQLFFTIVWGIFQILWSTVFGGGLVEGAKNIKVTKILGDMPDPTQFGIHDDVTEAEKTEGAEHGIRDELVQFVKGEKGETDIISDIFGIPTKKEGGSKHGHDAGLGDIAEILGSDIQSSLENNARKKKGLQIPETAKEAEAERKVEAEKADMEDGEKQDKAKEEQSEQPEEGKMKKKKRRHGQKIEKPEAVMANFFKALEIYQTKILHYLARNFYNLRFLALFVAFAINFILLFYKVTEEPLDEVEEDSNLWNSFEEEEEEEGMVFFVLEESTGYMAPALRALAVIHTIISFVCVIGYYCLKVPLVVFKREKEVARKLEFDGLYITEQPSEDDIKGQWDRLVINTPSFPNNYWDKFVKRKVINKYGDLYGAERIAELLGLDKNALDFSPVEESEPEAASLVSWLSSIDTKYHIWKLGVVFTDNSFLYLAWYTTMSILGHYNNFFFAAHLLDIAMGFKTLRTILSSVTHNGKQLVLTVGLLAVVVYLYTVVAFNFFRKFYNKSEDEDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTIPHGFETHTLQEHNLANYLFFLMYLINKDETEHTGQESFVWKMYQERCWDFFPAGDCFRKQYEDQLG

SEQ ID NO: 1688 - protein, 337 aa, Gallus gallus
MLSRLARPAAVLCRGLATSAQNNAKVAVLGASGGIGQPLSLLLKNSPLVSRLTLYDIAHTPGVAADLSHIETRANVKGFLGPEQLPECLKGCDVVVIPAGVPRKPGMTRDDLFNTNASIVATLTTACAKHCPEAMICIISNPVNSTIPITSEVFKKHGVYNPNRIFGVTTLDIVRANTFVAELKGLDPARVSVPVIGGHAGKTIIPLISQCTPKVDFPQDQLEKLTGRIQEAGTEVVKAKAGAGSATLSMAYAGARFVFSLVDAMNGKEGVIECSFVRSEETESPYFSTPLLLGKNGIEKNLGIGKITPFEEKMVAEAMAELKASIKKGEDFAKNFK

SEQ ID NO: 1689 - protein, 773 aa, Gallus gallus
MAAAELERLRMAGAGMAIAVLTSGGDAQGMNAAVRAVTRMGIYVGAKVFLIYEEHRQAPPGTPHVAERCATSPRLSPLQGGTVIGSARCKAFTTRQGRLRAARNLVEHGITNLCVIGGDGSLTGADVFRAEWAGLLDELLRDGLISEEVAKANGRLNVVGLVGSIDNDFCGTDMTIGTDSALHRIMEVIDAITTTAQSHQRTFVLEVMGRHCGYLALVSGLASGADWLFIPESPPEDGWEDLMCERLGETRSRGSRLNIIIIAEGAIDRNGKPISSNYVKDLVVQRLGFDTRVTVLGHVQRGGTPSAFDRVLSSKMGMEAVMALLEATPDTPACVVSLSGNQSVRLPLMECVQVTKDVQKAMDEKRFDEAIQLRGRSFENNWNIYKLLAHQKPAQEKQSPFSLAILNVGAPAAGMNAAVRSAVRISICRGHTIYAVSDGFEGLAKGQIREVGWHDVAGWLGRGGSMLGTKRTLPKTCMEKIVENVRKFNIQGLLVIGGFEAYEGVLQLVEARGQYEELCIIMCVIPATISNNVPGTDFSLGSDTAVNAAMESCDRIKQSASGTKRRVFIVETMGGYCGYLSTVTGIAVGADAAYVYEDPFTIHDLKANVEHLTDKMKTDIQRGLVLRNEKCHEHYTTEFLYNLYSSEGKGIFDCRINVLGHLQQGGAPTPFDRNYGTKLGVKAVLWMSEKLQEAYRKGRVFANSADSACVIGLRKKVVAFSPVTELKKVTDFEHRLPQEQWWLNLRLMLKMLANYQISLTEYISGKMEHVTRR

SEQ ID NO: 1690 - protein, 1021 aa, Gallus gallus
KSRLRRRREREITEITSEEEEEIEMVQHVHREFSPPSRLLRRRRSLSPTYIELMRPVSELIRPRSRPPEESERRSPTPERTRPRSPSPVSTERSLSRFERMARFDIFSRYESMKSALKTQKTMERKYEVLTQQPFTLDHAPRITLRMRSHRVPCGHNTRFILNVQSKPTADVKWYHNGIELQESSKIHFSNTSGVLTLEILDCHIDDSGTYRAVCTNYKGECSDYATLDVTGGDYTTYSSQRRDEEVPRSILPDLTRTEAYAVSSFKKATAAEASSSVREVKSEVSATRESLLSYEHHASSEEKITASEEKSLEERTVHKAFKSTLPATILTKPRSITVSEGETARFSCDVDGEPAPTITWVRAGQPIVSSRRFQITRTQYKSTFEISLVQIADEGSYTVVVENSEGRQEAHFTLTVQRKRIPEKAITSPPRIKSPEPRVKSPEPVKSPKRVKSPEPISTPSKAKSPPGDKTAPVEKVQLPTASPPKIKEQLKAETLGDKVKLSCAVESSVLSIREVAWYKDGKKLKEDHHFKFHYAADGTYELKIHNLTESDKGEYTCEIMGEGGISKTNFQFTGQVFKNIHSQVQSVSETPKSVEKGDKVLAVSTQKKSSAATEEKAAIEEVIKKSIVTEDVKQLQAEIRASSTQMTVSEGQKVTLKANIPGASEVKWVLNGMELRNSDDYRYGISGSNHTLTIKKASNKDEGILTCEGKTDEGTIKCQYVLTFSKEPSNEPAFITQPKSQNVNEGQDVLFTCEVSGDPSPEVEWLRNNQPIAVSSHMRATRSKNTYSLEIRNAAVSDTGKYTVKAKNYHGQCSATASLTVFPLIEEPPKEVVLKTSGDASMHESFSSQSFQMAASKQEASFSSFSSSSMTETKFASMSAKSMSSMKESFVEMSSSSIMGKSSMAQLESSTSKMLKSGVRGVPPKIEALPSDISIDEGKVLTLSCAFSGEPAPEITWYCRGRKITSQDQQGRFHIETSEDLTTLIIMDVQKNDGGIYTLNLGNEFGTDSATVNINIRSI

SEQ ID NO: 1691 - protein, 284 aa, Gallus gallus
MDAIKKKMQMLKLDKENALDRAEQAEADKKAAEERSKQLEDELVALQKKLKGTEDELDKYSESLKDAQEKLELADKKATDAESEVASLNRRIQLVEEELDRAQERLATALQKLEEAEKAADESERGMKVIENRAQKDEEKMEIQEIQLKEAKHIAEEADRKYEEVARKLVIIEGDLERAEERAELSESKCAELEEELKTVTNNLKSLEAQAEKYSQKEDKYEEEIKVLTDKLKEAETRAEFAERSVTKLEKSIDDLEDELYAQKLKYKAISEELDHALNDMTSI

SEQ ID NO: 1692 - protein, 423 aa, Gallus gallus
MALLQSRLLLSAPRRAAATARASSWWSHVEMGPPDPILGVTEAFKRDTNSKKMNLGVGAYRDDNGKSYVLNCVRKAEAMIAAKKMDKEYLPIAGLADFTRASAELALGENSEAFKSGRYVTVQGISGTGSLRVGANFLQRFFKFSRDVYLPKPSWGNHTPIFRDAGLQLQAYRYYDPKTCSLDFTGAMEDISKIPEKSIILLHACAHNPTGVDPRQEQWKELASVVKKRNLLAYFDMAYQGFASGDINRDAWALRHFIEQGIDVVLSQSYAKNMGLYGERAGAFTVICRDAEEAKRVESQLKILIRPMYSNPPMNGARIASLILNTPELRKEWLVEVKGMADRIISMRTQLVSNLKKEGSSHNWQHITDQIGMFCFTGLKPEQVERLTKEFSIYMTKDGRISVAGVASSNVGYLAHAIHQVTK

SEQ ID NO: 1693 - protein, 445 aa, Gallus gallus
MREIVHIQAGQCGNQIGAKFWEVISDEHGIDPTGSYHGDSDLQLERINVYYNEAAGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATVSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEGEEDEA

SEQ ID NO: 1694 - protein, 555 aa, Gallus gallus
AAMLSARVAAVLARSLPRQAGLVSRNALGAAFVATRNIHASKMGFQKTGTAEVSSILEERILGADTSAELEETGRVLSIGDGIARVYGLRNVQAEEMVEFSSGLKGMSLNLEPDNVGVVVFGNDRLIKEGDVVKRTGAIVDVPVGEELLGRVVDALGNPIDGKGPITSKTRRRVGLKAPGIIPRISVREPMQTGIKAVDSLVPIGRGQRELIIGDRQTGKTSIAIDTIINQKRFNDGTDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDSFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLNRGVRLTELLKQGQYVPMAIEEQVAVIYAGVRGHLDKLEPSKITKFESAFLAHVLSQHQALLSTIRTEGKISDQTEAKLKEIVTNFLSTFEA

SEQ ID NO: 1695 - protein, 1022 aa, Gallus gallus
MSRRTAEMFQQAFLSTLLCVALVPLHAQFDDEPVTSCTEKTDCPISVYFVIDTSESIALQTVPIQSLVDQIKQFIPRFIEKLENEVYQNQVSITWMFGGLHYSDVVEIYSPLTRSKDTYLTKLRAIRYLGRGTFTDCAISNMTQQFQSQTARDVKFAVVITDGHVTGSPCGGMKMQAERARDMGIKLFAVAPSEDVYEQGLREIASPPHDLYRSNYTITPKDALHIDENTIERIIKAMKHEAYAECYKMTCLEIAGPAGPKGYRGQKGAKGNMGEPGSPGLKGRQGDPGIEGPIGYPGPKGVPGLKGEKGEIGSDGRRGAAGLAGRNGTDGQKGKLGRIGPPGCKGDRGDKGPDGYPGDAGDQGERGDEGMKGDPGRPGRSGPPGPPGEKGSPGIPGNPGAQGPGGTKGRKGETGPPGPKGEPGRRGDPGTKGSKGGPGAKGERGDPGPEGPRGLPGEVGNKGARGDQGLPGPRGPTGAVGEPGNIGSRGDPGDLGPRGDAGPPGPKGDRGRPGFSYPGPRGPQGDKGEKGQPGPKGGRGELGPKGTQGTKGEKGEPGDPGPRGEPGTRGPPGEAGPEGTPGPPGDPGLTDCDVMTYVRETCGCCDCEKRCGALDIMFVIDSSESIGYTNFTLEKNFVVNVVSRLGSIAKDPKSETGARVGVVQYSHEGTFEAIKLDDERINSLSSFKEAVKRLEWIAGGTWTPSALQFAYNKLIKESRREKAQVFAVVITDGRYDPRDDDKNLGALCGRDVLVNTIGIGDIFDQPEQSETLVSIACNEPQRVQKMRLFSDLVAEEFIDKMEDMLCPDPQIVCPELPCQTELAVAQCTQRPVDIVFLLDGSERIGEQNFHRAHHFVEQVAQQLTLARRNDDNMNARIALLQYGSEREQNVVFPLTYNLTEISNALAQIKYLDSSSNIGSAIIHAINNIVLSPGNGQRVARRNAELSFVFITDGITGSKNLEEAINSMKKQDVMPTVVALGSDVDMDVLLKLGLGDRAAIFREKDYESLSQPSFFDRFIRWIC

SEQ ID NO: 1696 - protein, 51 aa, Gallus gallus
IRGRPAPEVKWGKVDGEIREAAIIDTTSSFTSLVLDSVNRFDTGKYTLTLE

SEQ ID NO: 1697 - protein, 284 aa, Gallus gallus
PMAIPPSYADLGKSARDIFNKGYGFGLVKLDVKTKSASGVEFTTSGSSNTDTGKVNGSLETKYKWAEYGLTFTEKWNTDNTLGTEIAIEDQIAKGLKLTFDTTFSPNTGKKSGKIKSAYKRECLNLGCDVDFDFAGPAIHGSAVFGYEGWLAGYQMTFDSAKSKLTRNNFSVGYKTGDFQLHTNVNDGSEFGGSIYQKVSDNLETAVNLAWTAGSNSTRFGIAAKYKLDSTASISAKVNNSSLVGVGYTQTLRPGVKLTLSALIDGKSINAGGHKLGLGLELEA

SEQ ID NO: 1698 - protein, 293 aa, Gallus gallus
MPLAGTPAPLKRKKPTKLIGKLTHEVMPQEVTKLNLGKKISIPRDVMLEELSLLTNKGSKMFKLRQLRVEKFIYENNPDAFTDNSVDHFQKFIPPGGHYGEDAHGYGHGRMVGGVTAGHHGSSKQHYSTVPPRPGSKGGPGDSEGEHAELSAGTAGEGGHGTEKDGKSGGKKPLVKTYISPWERAMGISPEDKSQLTIDLLSYSPKADFPHYKSFNRTAMPYGGYEKAAKRMTFKVPQFDICPLLPESLVLYNQNFRNRPSFNRTPIPWMPSGESSEYHTDINVPRSGETEEL

SEQ ID NO: 1699 - protein, 364 aa, Gallus gallus
MTHQFPALSPEQKKALSDIAQRIVASGKGILAADESVGTMGNRLQRINVENTEENRRAFREILFSSDASISKSIGGVILFHETLYQKDSSGKPFPAIIKEKGMVVGIKLDAGTAPLAGTNGETTIQGLDKLAERCAQYKKDGADFGKWRAVLKISSTTPSQLAIQENANTLARYASICQQNGLVPIVEPEVLPDGDHDLQRCQYVTEKVLAAVYKALNDHHVYLEGTLLKPNMVTAGHSCPKKYTPQDVAVATVTTLLRTVPAAVPGICFLSGGQSEEEASLNLNAMNQSPLPKPWKLTFSYGRALQASALAAWLGKSENKKAAQEAFCKRAQINSLACRGQYVTSGKTDTAATQSLFTASYTY

SEQ ID NO: 1700 - protein, 339 aa, Gallus gallus
MSTVHEILSKLSLEGDHSLPPSAYATVKAYSNFDADRDAAALEAAIKTKGVDEVTIINILTNRSNEQRQDIAFAYQRRTKKELSAALKSALSGHLEAVILGLLKTPSQYDASELKAAMKGLGTDEDTLIEIICSRTNQELNEINRVYREMYKTELEKDIISDTSGDFRKLMVALAKGKRCEDTSVIDYELIDQDARELYDAGVKRKGTDVPKWINIMTERSVPHLQKVFERYKSYSPYDMLESIKKEVKGDLENAFLNLVQCIQNKQLYFADRLYDSMKGKGTRDKVLIRIMVSRCEVDMLKIKSEFKRKYGKSLYYFIQQDTKGDYQRALLNLCGGED

SEQ ID NO: 1701 - protein, 358 aa, Gallus gallus
MFSSIAPLARLNPFYAPHFQLCQDGLRRRAEPAEAPTTRRSLAAASATEEYSCEYGSGRFFMLCGFGGIISCGTTHTALVPLDLVKCRMQVDPQKYKSIFNGFSVTIKEDGFRGLAKGWAPTFIGYSMQGLCKFGFYEVFKILYGNMLGEENAYLWRTSLYLAASASAEFFADIALAPMEAAKVRIQTQPGYANTLRQAVPKMFGEEGIWAFYKGVAPLWMRQIPYTMMKFACFERTVEALYKYVVPKPRSECSKGEQLVVTFIAGYIAGVFCAIVSHPADSVVSVLNKEKGSSASQVLKRLGFRGVWKGLFARIIMIGTLTALQWFIYDSVKVYFRLPRPPPPEMPESLKKKLGLTQ

SEQ ID NO: 1702 - protein, 447 aa, Gallus gallus
RECISIHVGQAGVQIGNACWELYCLEHGIQPDGQMPSDKTIGGGDDSFNTFFSETGAGKHVPRAIFVDLEPTVIDEVRTGTYRQLFHPEHLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNSCFEPANQMVKCDPRHGKYMACCLLYRGDVVPKDVNAAIATIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGLDSYEDEEEGEE

SEQ ID NO: 1703 - protein, 742 aa, Gallus gallus
MSQVKIPAEDKQIDEATRSFAEKVFASEVKDEATRQEISPFDVEEICPISRHEMRTHMMLQESSSATEKRRKRMLSLKTIALAVPLAQKTTTGLSTIDEVISTSPQYQSVPDFQRVQITGDYASGVTVEDFEVVCKGLYRALCIREKYMQKSLQRFPRTPSQYLRAIEGEVWRASDAGPVFTPPVKDGQDPFETGNLPEDLGYHVQMKDGIVYIYSDKAAAGRNEPKDLPYPSLEHFVDDMNFLLALIAQGPVKTYSHRRLKFLSYKFQVHEMLNEMEEIKELKNNPHRDFYNCRKVDTHIHAAACMNQKHLLRFIKKSYRVDADRVVYDAKGEKLTLKQLFQKLNLHPYDLTVDSLDVHAGRQTFQRFDKFNAKYNPVGASELRDLYLKTENTINGEYFATIIKEVGSDLEDAKYQHAEPRLSIYGRSAEEWAKLANWFNRHRVYSPNMKWMIQVPRIYDVFRSRNFLPHFGKMLENIFVPVFEATVNPQAHKELSVFLRHITGFDSVDDESKHSGHMFSTKSPKPEQWTSAKNPSYTYYVYYMYANILVLNNLRRQRGMNTFLFRPHCGEAGAITHLLAAFMTADNISHGLNLKKSGERQYLYFLAQIPIAMSPLSNNSLFLEYAKNPLLDFHQKGLMVSLSTDDPMQFHYTKEPLMEEYAIAAQVFKLSTCDMCEIARHSVLQCLSHEEKAKFLGENYQEEGPHGNDVRKTNVAQIRMAYRYETWCYELNLIAEGLIAE

SEQ ID NO: 1704 - protein, 869 aa, Gallus gallus
SGRAGRHPSGGRMKETCRICARELCGNQRRWIFHTAAKLNLQVLLSHVLGRELCRDGRGEFACSKCAFMLDRIYRFDTVIARIEALSIERLQKLLLEKDRLKFCIASMYRRNNEEPGADERAGDGTVDLSNLPDARYAALLQEDFAYSGYEYWTDQDEHSLEPHSCHASEGAASRPRRCRGCAALRVADADYEAICKVPRKVARSISCGLSSRWSVSMGNEESSVCDPTEPAGARGPVDGESMEEGTPASSVESLDTTVEASAPQQKDEDVDKGVKGNGKCDDFAEDRMTPSSSLSGNRLELALSLIKGLDYKPIQSPRGSRLPIPVKSSLPPPKLSRDLADGSASAGLAYAGSGFLNADRKSFSRAPLGLPLEIPELQELWDDFCEDYMPLRVQKPFVSNLQDEHQKPAPGDSASRECTADLCATEPQGKIQQFEDTNQLLQEKLNELNFELKSARETSQRQDLTIQSLNEALKSKESETEELYHVIEGQNETMAKLQDMLHRSQLGQLQMSESAPSSQEQQVALLDLQNTLFSTQLEVQKLKRAQRQKEHQLVEAKRAAQLLETTVHEEEQQKEATWKHNQELRAVVQQLQVELQDKAQQIQAMEWEKCRELQAQEQRVQCLSQHLARKEQLLQESRELLQCQQSLGRSSAAMDAMLEKLQQRVSDRDAALERAVDEKFCALEEKEQELQQLRLSIKERGGDLERLRNVLSSNEATIHSLESLLKAKTLELEQMSATCENLRWLKEEIEAKSCSRQKEQEGIIQQLQTCLHDRNKEVEELTATLLCKLGPGQSEVAEELCLRLQRKEKMLQELLSDRNRQAMEHDAEIRELLQAMSTKEQWSKATTEKMVHALAERNCELQLLRQHV

SEQ ID NO: 1705 - protein, 605 aa, Zea mays
MAALATSQLVATRAGLGVPDASTFRRGAAQGLRGARASAAADTLSMRTSARAAPRHQQQARRGGRFPSLVVCASAGMNVVFVGAEMAPWSKTGGLGDVLGGLPPAMAANGHRVMVVSPRYDQYKDAWDTSVVSEIKMGDGYETVRFFHCYKRGVDRVFVDHPLFLERVWGKTEEKIYGPVAGTDYRDNQLRFSLLCQAALEAPRILSLNNNPYFSGPYGEDVVFVCNDWHTGPLSCYLKSNYQSHGIYRDAKTAFCIHNISYQGRFAFSDYPELNLPERFKSSFDFIDGYEKPVEGRKINWMKAGILEADRVLTVSPYYAEELISGIARGCELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPAYEEMVRNCMIQDLSWKGPAKNWENVLLSLGVAGGEPGVEGEEIAPLAKENVAAP

SEQ ID NO: 1706 - protein, 883 aa, Zea mays
MAPAPCGRSSQRVFHFGKGKSEGNKNMKELLGGKGANLAEMASIGLSVPPGFTVSTEACQQYQEAGRALPPGLWAEVLDGLRWVEEYMGAALGDPRRPLLLSVRSGAAVSMPGMMDTVLNLGLNDQVAAGLAAKSGDRFAYDSFRRFLDMFGNVVMDIPHALFEEKLEAMKKAKGLKNDTDLTATDLKELVSQYKNVYVEAKGEPFPSDPKRQLELAVLAVFDSWESPRAKKYRSINQITGLRGTAVNVQCMVFGNMGNTSGTGVLFTRNPNTGEKKLYGEFLVNAQGEDVVAGIRTPEDLDAMKDVMPQAYKELVENCRILESHYKEMQDIEFTVQESRLWMLQCRTGKRTGKSAVKIAVDMVNEGLVERRAAIKMVEPGHLDQLLHPQFENPSAYKDQVIATGLPASPGAAVGQVVFTAEDAETWHSQGKSVILVRAETSPEDVGGMHAAAGILTERGGMTSHAAVVARGWGKCCVSGCSGIRVNDAEKVVKIGGNVLREGEWLSLNGSTGEVILGKQPLSPPALSGDLGTFMSWVDDVRKLKVLANADTPEDALAARNNGAEGIGLCRTEHMFFASDERIKAVRQMIMAPTVELRQQALDRLLPYQRSDFEGIFRAMDGLSVTIRLLDPPLHEFLPEGNVEEIVRELCSETGANQEDALARIEKLSEVNPMLGFRGCRLGISYPELTEMQARAIFEAAIAMTNQGVQVFPEIMVPLVGTPQELGHQVALIRQVANKVFTSMGKTIGYKIGTMIEIPRAALVADEIAEQAEFFSFGTNDLTQMTFGYSRDDVGKFIPIYLAQGILQHDPFEVLDQRGVGELVKLATERGRKARPNLKVGICGEHGGEPSSVAFFAKTGLDYVSCSPFRVPIARLAAAQVLV

SEQ ID NO: 1707 - protein, 437 aa, Zea mays
MAATMAVTTMVTRSKESWSSLQVPAVAFPWKPRGGKTGGLEFPRRAMFASVGLNVCPGVPAGRDPREPDPKVVRAADNCDIARQLGAAVPGQQAAWEAEEEAAKRRKQKGGGSKKQQQLGDLSLRKVRVKIANPHLRRLVSGAIAGAVSRTFVAPLETIRTHLMVGSIGVDSMAGVFQWIMQNEGWTGLFRGNAVNVLRVAPSKAIEHFTYDTAKKFLTPKGDEPPKIPIPTPLVAGALAGFASTLCTYPMELIKTRVTIEKDVYDNVAHAFVKILRDEGPSELYRGLTPSLIGVVPYAACNFYAYETLKRLYRRATGRRPGADVGPVATLLIGSAAGAIASSATFPLEVARKQMQVGAVGGRQVYQNVLHAIYCILKKEGAGGLYRGLGPSCIKLMPAAGIAFMCYEACKKILVDKEDEEEEDEAGGGEDDKKKVE

SEQ ID NO: 1708 - protein, 947 aa, Zea mays
MAASVSRAICVQKPGSKCTRDREATSFARRSVAAPRPPHAKAAGVIRSDSGAGRGQHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARWWGKCCVSGCSGIRVNDAEKLVTIGSHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLTYQRSDFEGIFRAMDGLPVTIRLLDHPSYEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVHLAQGILQHDPFEVLDQRGVGELVKFATERGRKARPNLKVGICGEHGGEPSSVAFFAKAGLDFVSCSPFRVPIARLAAAQVLV

SEQ ID NO: 1709 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTK

SEQ ID NO: 1710 - protein, 802 aa, Zea mays
MAAKLTRLHSLRERLGATFSSHPNELIALFSRYVHQGKGMLQRHQLLAEFDALFDSDKEKYAPFEDILRAAQEAIVLPPWVALAIRPRPGVWDYIRVNVSELAVEELSVSEYLAFKEQLVDGQSNSNFVLELDFEPFNASFPRPSMSKSIGNGVQFLNRHLSSKLFQDKESLYPLLNFLKAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFAQSNVLGYPDTGGQVVYILDQVRALENEMLLRIKQQGLDITPKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKADPSYWDEISQGGLQRIYEKYTWKLYSERLMTLTGVYGFWKYVSNLERRETRRYIEMFYALKYRSLASQVPLSFD

SEQ ID NO: 1711 - protein, 365 aa, Zea mays
MGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGAMCEPLSVGVHACRRAGVGPETGVLVVGAGPIGLVSLLAARAFGAPRVVVVDVDDHRLAVARSLGADAAVRVSPRAEDLADEVERIRAAMGSDIDVSLDCAGFSKTMSTALEATRPGGKVCLVGMGHNEMTLPLTAAAAREVDVVGFRYKDTWPLCIDFLRSGKVDVKPLITHRFGFSQRDVEEAFEVSARGRDAIKVMFNL

SEQ ID NO: 1712 - protein, 366 aa, Zea mays
MGKGAQGSDAAAAGGEVEENMAAWLVAKNTLKIMPFKLPPVGPYDVRVRMKAVGICGSDVHYLREMRIAHFVVKEPMVIGHECAGVVEEVGAGVMHLSVGDRVALEPGVSCWRCRHCKGGRYNLCEDMKFFATPPVHGSLANQVVHPADLCFKLPDGVSLEEGAMCEPLSMGVHACRRAGVGPETGVLVVGAGPIGLVSLLAARAFGAPRVLVVDVDDHRLAVARSLGADAAVRVSPRVEDLADEVERIRAAMGSDIDVSLDCAGFSKTMSTALESTRPGGKVCLVGMGHNEMTLPLTAAAAREVDVVGVFRYKDTWPLCIDFLRSGKVDVKPLITHRFGFSQRDVEEAFEVSARGRDAIKVMFNL

SEQ ID NO: 1713 - protein, 389 aa, Zea mays
MSHRKFEHPRHGSLGFLPRKRSSRHRGKVKSFPRDDAKKPCHLTAFLGYKAGMTHIVREVEKPGSKLHKKETCEAVTIIETPPLVIVGLVAYVKTPRGLRTLNSVWAQHLSEEVRRRFYKNWCKSKKKAFTKYALKYENDAGKKEIQLQLEKMKKYASVIRVIAHTQIRKMKGLKQKKAHLMEIQVNGGTIADKVDYGYKFFEKEVPVDAVFQKDEMIDIIGVTKGKGYEGVVTRWGVTRLPRKTHRGLRKVACIGAWHPARVSYTVARAGQNGYHHRTEMNKKVYKIGKAGQETHDASTEFDRTEKDITPMGGFPHYGIVKGDYLMIKGCCVGPKKRVVTLRQSLLKQTSRLALEEIKLKFIDTSSKFGHGRFQTTDEKQRFFGKLKA

SEQ ID NO: 1714 - protein, 766 aa, Zea mays
MAAAAIPSKLATQVLIPVAAAVGIAFAVVQWVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPALANAIFSTIAFVLGAVTSLVSGFLGMKIATYANARTTLEARKGVGKAFITAFRAGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWL

SEQ ID NO: 1715 - protein, 208 aa, Zea mays
MVSLKPQKRLAAGVLKCGKGKVWLDPNEVYEISMANSRQNIRKLVKDGFIIKKPQKIHSRSRARRAHEAKQKGRHSGYGKRRGTREARLPTKILWMRRMRVLRRLLRKYREAKKIDKHMYHDMYMKVKGNMFKNKRVLMESIHKSKAEKAREKTLSDQFEAKRAKSKASRERKIARREERLAQGPREPAAAPVSATAPFAAAPKKAKK

SEQ ID NO: 1716 - protein, 207 aa, Zea mays
MVSLKLQKRLAASYLKCGKGKVWLDPNEVSEISMANSRQNIRKLVKDGFIIKKPHKIHSRSRARRAHDAKQKGRHSGYGKRRGTREARLPTKVLWMRRMRVLRRLLRKYREAKKIDKHMYHDMYMKVKGNAFKNKRVLMESIHKSKAEKAREKTLSDQFEAKRAKSKASRERKIARREERLAQGPREITPPVSSTAPATGAPKKAKK

SEQ ID NO: 1717 - protein, 767 aa, Zea mays
MAAAAILPELGTQVLIPVAAAVGIAFSVLQWVLVSKVRLAPERRADGGGAVKSGPSDYLIEEEEGLNDHNVVVKCAEIQNAISEGATSFLFTEYKYVGLFMGIFAILIFLFLGSVEGFSTKSQPCHYSKDKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHQFTPMVYPLLVSSVGIIACLITTLFATDFFEIKAVNEIEPALKKQLIISTVVMTIGIALISWLGLPYTFTIYNFGAQKTVQSWQLFLCVAVGLWAGLVIGFITEYYTSNAYSPVQVVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLAGVLAGALVSGVQIAISASNTGGAWDNAKKYIEAGASEHARTLGPKGSDPHKAAVIGDTIGDPLKDTSGPSLNILIKLMAVESLVFAPFFAAHGGIIFKWL

SEQ ID NO: 1718 - protein, 204 aa, Zea mays; identical to SEQ ID NO: 567

SEQ ID NO: 1719 - protein, 765 aa, Zea mays
MAVLGTAAVEVLIPVAALVGIAFALLQWYVVARVPVPSHAGEDGGGGGNKNVREEEEHVEEDGMDYLLVEARCAEIQRAISVGATSFLLTEYKYLAVFTAAFAVVIFVFLGSAQRFSARPGPCAYDPSRECRPALANAAFSAVAFLLGAATSVLSGYLGMRVATFANARTALEARHGVGRAFAAAFRSGAAMGFLLASSALLVLYAAVNLFGLYYGDDWGGLYESITGYGLGGSSVALFGRVGGGIYTKAADVGADLVGKVERNIPEDDPRNPAVIADNVGDNVGDIAGMGSDLFGSYAESSCAALFVASISSFGAEHNLTAMMYPLLISAVGLLVCAITTVVATDVTEVKGSDEVGPALKRQILISTVLMTAGIAAVTFLALPPSFTLFDFGNDKHVKNWHLFICVSAGLWAGLVIGYVTEYFTSNAYGPVQAVARSCRTGAATNVIFGLAVGYKSVIVPIVAIAAAIYASFRLAAMYGIALAALGMLSTIATGLAIDAYGPISDNAGGIAEMAGMPHRVRERTDALDAAGNTTAAIGKGFAIGSAALVSLALFGAYVSRAGITAVDVLSPRVFVGLLLGAMLPYWFSAMTMRSVGSAALRMVEEVRRQFDTIPGLAEGLAVPDYATCVRISTDASLKKMMAPGALVMFSPLVAGTLFGVETLAGLLAGALVSGVQVAISASNSGGAWDNAKKYIEAGLSEEARSLGPKGSEAHKAAVIGDTIGDPLKDTSGPSLNILIKLMAVESLVFAPFFAAHGGIIFDHL

SEQ ID NO: 1720 - protein, 337 aa, Zea mays
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGGVHDGTAVVLWEWCKGENQSWKILPWGPEANSSAAHAGGPHAVRVFCKAGGEDYSLTVRNGTACLAPTNPRDEYQHWVKDMRHSTRVRDEEGYPAFALVNKVTGEALKHSTGQGHPVKLVPYNPDYQDESVLWTESRDVGNGFRCVRMVNNIYLNFDAFHGDKAHGGVHDGTEIVLWKWCEGDNQRWKILPW

SEQ ID NO: 1721 - protein, 447 aa, Zea mays
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQITEPKRPSDKPLRLPLQDVYKIGGIGTVPVGRVETGVIKPGMVVTFGPTGLTTEVKSVKMHHEALQEALPGDNVGFNVKNVAVKDLKRGFVASNSKDDPAKEAASFTSQVIIMNHPGQIGNGYAPVLDCHTSHIAVKFAELITKIDRRSGKELEKEPKFLKNGDAGMVKMIPTKPMVVETFSQYPPLGRFAVRDMRQTVAVGVIKSVEKKDPTGAKVTKAAAKKK

SEQ ID NO: 1722 - protein, 483 aa, Zea mays
MAAAIVLSGQVRPLPSSLPLSLLLLLLLCCSGTSWGWSTSRGGAARECGFDGKLEALEPRHKVQSEAGSVQYFSRFNEADRELTCAGIFAVRVVVDAMGLLLPRYSNVHSLVYIVQGRGIIGFSFPGCQEETQQQQYGYGYGYGHHHHQHDHHKIHRFEQGDVVAMPAGAQHWLYNDGDAPLVAVYVFDENNNINQLEPSMRKFLLAGGFSKGQPHFAENIFKGIDARFLSEALGVSMHVAEKLQSRRDQRGEIVRVEPEHGFHQLNPSPSSSSFSFPSSQVQYQTCQRDVDRHNVCAMEVRHSVERLDQADVYSPGAGRITRLTSHKFPVLNLVQMSAVRVDLYQDAIMSPFWNFNAHSAMYGIRGSARVQVASDNGTTVFDDVLRAGQLLIVPQGYLVATKAQGEGFQYIAFETNPDTMVSHVAGKNSVLSDLPAAVIASSYAISMEEAAELKNGRKHELAVLTPAGSGSYQQGQAGSAQQ

SEQ ID NO: 1723 - protein, 251 aa, Zea mays
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGENDLPGLTDTEKPRMRGPKRASKIRKLFNLNKDDDVRKYVNTYRRTFTTKNGKKVSKAPKIQRLVTPLTLQRKRARIADKKKRITKKKSEAAEYQKLLAQRLKEQRDRRSESLAKRRSKLSAAVKASAATSA

SEQ ID NO: 1724 - protein, 377 aa, Zea mays
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 1725 - protein, 377 aa, Zea mays
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 1726 - protein, 207 aa, Zea mays
MVSLKVPKRLAASVLKCGKGKVWLDPNEVSEISMANSRHNIRKLVKDGFIIKKPQKIHSRSRARRAHEAKQKGRHSGYGKRRGTREARLPTKVLWMRRMRVLRRLLRKYREAKKIDKHMYHDMYMKVKGNSFKNKRVLMESIHKSKAEKAREKTLSDQFEARRAKSKASRERKNARREERLAQGPREIPPPVSATAPTTGAPKKAKK

SEQ ID NO: 1727 - protein, 246 aa, Zea mays
MSTEEAVVAEVPVTEVPAEVPAAQVAEAPKAKKAPKEKKAPKEKKPSAAKKPAAHPPYAEMIVEAIAALKERKGSSSVAISKYVEGKHGGKLPTNFRKQLTVQLKKLAAAGKLTRVKNSFKLPATDAKPKAAKPKAPKAAPKPKPSPKAKAKTAAKPKAASPKPKAKAKAKAKPVAPAAASPKPRGRPPKVAKTSAKASPAKAAKKAAAPAKKGKAAAAPKKVATPKKAAAAAAPVRKGVARKAKK

SEQ ID NO: 1728 - protein, 355 aa, Zea mays
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVLFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 1729 - protein, 377 aa, Zea mays
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDMKEKLAYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 1730 - protein, 459 aa, Zea mays
MAPANVRAAQAQAPSADRRLSTLVGHLLPSSPRRAAADTSATSTLESFPTMASQGSSVFAALEQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLLEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCKSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 1731 - protein, 172 aa, Zea mays
MANPRVFFDMTVGGAPAGRIVMELYANEVPKTAENFRALCTGEKGVGKSGKPLHYKGSTFHRVIPEFMCQGGDFTRGNGTGGESIYGEKFPDEKFVRKQPAPGVLSMANAGPNTNGSQFFICTVATPWLDGKHVVFGQVVEGMDVVKAIEKVGTRNGSTSKVVKVADCGQLS

SEQ ID NO: 1732 - protein, 155 aa, Zea mays
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNTECGAGVFMANHFDRHYCGKCGLTYVYNQKA

SEQ ID NO: 1733 - protein, 403 aa, Zea mays
MVAVNRPLVSVKALEGDMVTDAPGIALPPVFGAPIRPDVVRFTHKLLSCNKRQPYAVSRRAGHQTSAESWGTGRAVSRIPRVPGGGTHRAGQGAFGNMCRGGRMFAPTKIWRKWHRRVNINLRRVAVASALAATAVPALVQARGHRIESVPEMPLVISDSAESIEKTSQALKILKQIGAHADAEKAKDSVGIRPGKGKMRNRRYINRKGPLIVYGTEGSKVVKAFRNLPGVDVANVERLNLLDLAPGGHLGRFVIWTQSAFNKLEEVYGSYDAPSQKKKGFVLPRPKMSNADLGRIINSDEVQSVVKPLNKEVKRREKRKNPLKNMAAVLKLNPYLGTARKMATLAEAARVKARKAKLDSKRTKLTPETAKVKAAGKAWYKTMVSDSDYTEFENFSKWLGVTQ

SEQ ID NO: 1734 - protein, 414 aa, Zea mays
MAGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILGSGVHVVVGTPGRVFDMLRRQSLRPDNIKMFVLDEADEMLSRGFKDQIYDIFQLLPAKIQVGVFSATMPPEALEITRKFMNKPVRILVKRDELTLEGIKQFYVNVDKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVLIEELPANVADLL

SEQ ID NO: 1735 - protein, 156 aa, Zea mays
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGYGGGNRGGGYGNSDGNWRN

SEQ ID NO: 1736 - protein, 659 aa, Zea mays
MGKSSKKAAAVAAAPAAVPKGKKREAEEEIEKAVSAKKQKAAPPAKAVPTSKKDAKKSKKQPPPKKAESSSSDSEEDSESEEEVKKVQPKKAPAPKIAKQESSDDDTSDETSESDEEPAKKPAAKPLAAVAKNGSKTVKQESSSDEDSSEDESDDDSDDEPAKKAAAKPLGAVAKNGLKKGKQESSSDGSSSDDESDDDVKPAAPLKKTSVAVAQKKKGDSSESDSDDDSDEEVPPKSKAPAATIKKEDSSESESESDSEVEDASKTQPAKRAASKMKDESSDDSDTDEDEEPPQKKQKEALSAAKKESSSEDEDDSSEESSDDEPTKVEEKKAPKVSENSGSEDESSEDESDKDSEEPANTPKKAAVHASEKKTATKEPKTPTGSQSESTEVNTLFMGNVPWKAEFDDVKEFFEDVGEVVDVRFPTHDDGNRKGFCYVEFVSAEAAAKAYKEKQSKELHGREVRLDFAKGRSTQTPRSGNDGSFQKAARGNSSSIFIRGFDKNLSEDEIRSSLEQHFSDCGEMTRVSIPTDHESGAIKGMAYIDFKDQDSVSKALELSGSDIGGGYELYVDEAKPRGDGQRGGGRSGGRSGGRFGDRSGGRRGGGRFGERSGGRDGGGRFGGRRGGRDGGRGRGGRGFGNKHSAGTPSAGKKTTFGDD

SEQ ID NO: 1737 - protein, 1293 aa, Zea mays
MGRKKNVAIDDDEYFFPQDDAADPAPPPPAPAAADKEKSKKGGKKGKKGGKAAAPDDDDYEPPPPPPPAADEDDDGEPINLVFTGKKKKKKGATPAAPFSAFSALGEEGEDQDEEDPAPSAAAEPEAINDPAEDDDDVVDFDFSKAKKKKKKDKGPRSAPAKDEDVEPAPPPPPVAEEEDEEPPVIAAAAAKKPQKKKKKKGAFMMDGENVDQILAGMEDPQLMDEPEPEEVKAQDSVAAPDADDATGKKSKKKKKKGGFTMDVDGEEFDQILAVIDDLPPPEEEPEPKDPKDEGTAATAALVDDAEGKKSKKKKKKSGRTAKEEEELDKILAELDGVPPVEEDKPTQAPQSAALAKEDVGAAEDGNVEDKAEEGGEVESAAAKKKKKKKEKEKEKKAAAKGAESKKGEEQEAPKGKVDMKKLPKHVREMQEALARRKEAEERQKREEEERLRKEEEERLRREEEERKAEEAKRRRKEREKEKLLKKKQEGKLLTGKQKEEAKRLEAMRRQFLEQSELQKAEDAAPETKKRPIYDSKKKKAQSKATETAKVVEEQQEELNEVNNDEEEYVLVDQESQSQVEESDEKTEPDQETEEPKPEEDEEDEDEWDAKSWDDIDVNLPKISAFDEEEAKPIVKKAEPVQKQENNKAQPAIPAAKKLVPSVADSKKSETDDVGASNGNVKRHKKKGPVKEDNSKSGSDLRSPICCILGHVDTGKTKLLDCIRRTNVQEGEAGGITQQIGATYFPTENIRERTRELKADATLKVPGLLVIDTPGHESFSNLRSRGSSLCDIAILVVDIMHGLEPQTIESLNLLKSRDAVFIVALNKVDRLYGWKKCPNAPIVKALKQQNEDVKREFNMRLTDIVTQFKMQGVNTALYYKNKEMEDTFNIVPTSAVSGEGIPDLLLLLVQWTQKTMEEKLTFVDEVQCTVLEVKVVEGHGTTIDVVLVNGILHEGDQIVVCGMQGPIVTTVRALLTPHPMRELRVKGTYIHHKEIRAAQGVKISAQGLEHAIAGTALYVLGPDDDLDKLNEAVMEEMTRVRSRIDRSGEGVYVQASTLGSLEALTEFLKSPAVNIPFCDFSIGPVHKKDVMKASVMLERKKEYATILAFDVKVMPDARDLAEESGVRIFVADIIYHLFDQFTAYIKNLKEEKKKESAEEAVFPCVLKIMPNCVFNKKDPIVLGVDVLEGIAKVGTPLCIPSKEFIDIGKIASVEINHKQVDMATKGQKVAIKIIANNSDEQQRSFGRHFDMEDELVSRISRRSIDILKQNYREDLTTEDWKLVVKLKSILKIQ

SEQ ID NO: 1738 - protein, 152 aa, Zea mays
  MOD_RES (33)..(35): Any amino acid
MAPKAEKKPAAKKPAEEEPAAPAEKAPAGKKPXXXKRLPAGKSAGKEGGVDKKGRKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 1739 - protein, 206 aa, Zea mays
MAKIAAAAAAALCFAALVAVAVCQGEVERQRLRDLQCWQEVQESPLDACRQVLDRQLTGGGGGGGVGPFRWGTGLRMRCCQQLQDVSRECRCAAIRSMVRGYEEAMPPLEKGWWPWGRQQQPPPQGGGGGQGGYYYPCSRPGEGYGYGQGGQRQMYPPCRPGTTGGGPRIGRVRLTKAREYAAGLPMMCRLSEPQECSIFSGGDQY

SEQ ID NO: 1740 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMDVVAAQTKAIAEKIKDWSNVVVAYEPVWAIGTGKVATPAQAQEVHASLRDWLKTNASPEVAESTRIIYGGSVTAANCKELAAQPDVDGFLVGGASLKPEFIDIINAATVKSA

SEQ ID NO: 1741 - protein, 269 aa, Zea mays
MATEVAETPAPLAEAVPETPAEAPAAPAAEANSTKAKKASAPKKRANPTHPPYAEMISEAVTSLKERTGSSQYAIAKFVEDKHKDKLPPNFRKLLLGQLKKLVAAGKLTKVKNSYKLPARAPAAAKPKPKSKTAVKKPKAGAKKPKAATKPKPKAKAKSPAKAKPAAKPKAAAKPKPAAAKPKAAAKPKAKPAAKAKPKAVAAKPKPAAKKAGRPAKAAKTSAKDTPGKKAAPAKKPAAAAKKAPAKKAAPAKKAPTPSRKVPSRKAKK

SEQ ID NO: 1742 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 1743 - protein, 307 aa, Zea mays
MAAATPSPHSARVAVVTGGNKGIGLEVCRQLASNGITVVLTARDEKRGAAAVEELADAGLSGVVFHQLEVTDAQSIARLAGFLKAWFGKLDILVNNAAIGGVQSLPVENVGEKIKGMDASQMAELMWKSCRETNDAAKAGVQTNYYGVKNVTEALLPLLLQASSSGGGRVVNVSSDFGLLRYLRNEEVKRELDDIEGLTEERLDELLSTFLRDFEAGALESRGWPTEFAAYKVAKAALNSYSRVLARRHPELRVNCAHPGYVKTDMTRQTGLLTPAQGAANVVKVALLPEGGPTGAFFALGKEAPFV

SEQ ID NO: 1744 - protein, 308 aa, Zea mays
MKLVLVVLAFIALVSSVSCTQTGGCSCGQQQSHEQQHHPQQHHPQKQQHQPPPQHHQQQQHQQQQVHMQPQKHQQQQEVHVQQQQQQPQHQQQQQQQQHQQQHQCEGQQQHHQQSQGHVQQHEQSHEQHQGQSHEQQHQQQFQGHDKQQQPQQPQQYQQGQEKSQQQQCHCQEQQQTTRCSYNYYSSSSNLKNCHEFLRQQCSPLVMPFLQSRLIQPSSCQVLQQQCCHDLRQIEPQYIHQAIYNMVQSIIQEEQQQQPCELCGSQQATQSAVAILTAAQYLPSMCGLYHSYYQNNPCSSNDISGVCN

SEQ ID NO: 1745 - protein, 344 aa, Zea mays
MFGFGHHGQNPPAHGGVHQPTFKIFCKSDEGYCLTVRDGNVVLAPANPRDEHQHWYKDMRFSTQVKDEEGNPAFALVNKATGLAIKHSLGQSHPVKLVPFNPEYQDESVLWTESGDVGKGFRCIRMVNNIRLNFDAFHGDKGHGGVHDGTTVVLWEWAKGDNQSWKILPWGDEAYAAGGSSAANAPRFGGGGEPTVRIYCKADEGFSATVRNGAVCLAPTNPRDEYQHWIKDMRHSNSVKDEEGYPAFALVNRVTGEAIKHSQGEGHPVKLVPYNPGYQDESVLWTESRDVGHGFRCVRMVNNIYLNFDAFHGDKDHGGVRDGTNIVLWKWCEGDNQRWKIVPW

SEQ ID NO: 1746 - protein, 1325 aa, Zea mays
MEAEVSAPADLKAPDKTTVHGDDKENIPNGNANLQVKEADNDEDDGTRSDGFELIDVKQNFDSARVEEEMAAPRSTTVDTSPVTEESETQEDKTTAHEEQSVATNTRHLESSMLNQQTEQLEKLTMRIEELESENDKLVKDLTEAENKQSLHYSCLQEAQCSLAMKDKELAEVTESLKDLGSELGTSKKRIQEIEAELDSSADKLCKLEELKDERSLHAAQEAKRASELDKMLELAQSNMKEMEKHIGSLQEEVKGYQDKAADHQQIEESLRNTISELKVVQEALELSKSQVENLKQKLASQDTDFSKLTEELNLHCSSEESLKEKSLKLETELTTVLEELQAKGGLDKLKDENKTLQGSLVDLNSKLSEKDSILHQAEDELSKAQLVLLEALSQKEELELNLNSLSEQHGKSKAFGENANQKILDLEAQIQAMHAAEQALKFELKEAEASVQAAEKKGSDLEQQLSEIENKFVKSSEEIELLKERIQQEAAVSAERGMQLQETVTSVEGYKEKIIELQSSLGSSVSKNQLLEQEVMELTDKCSEHQEQAHSVRQRSLELEDLLHTSKTHAEGVYSRTQELEQELNNTYEMFKGVEEELEQYRSKASQLSDDLEAYQTKAASLEAVVEAASEKEKEFMESLSQITEEKKKTESRNAEIEAQLQEALEAVGQKEAESRNLNEKLVALESEIESSMHVNEALKQEINAKLVMVDELQEKCSFISSEKEEVAEKLSIHEEKLEHLTEEHSRGLELLSVAESRNKETESQLREVLEKLAQKEAEVTDLTEKLALLEAENEKMTCLNEALKEVDAKLVMFDELQERFSSTLAEKEEAAEKLAVHERTISQLTEVHTRTLELHSVAESKNEEIGAQFLEALETISQKEGEVKESSSQKIKILEEQLAETHSKVEHFLTEKESLVQETSSLNKEFEVHQNKLNDLQLALAAALAEKEAAFEEIHSLCKTLDGMIEHKAELEIQVSSTIQEHEELKSKYQNTMEEKQMLSDKYETAKKELEDAIAKLEEEMNVDKSEKESHISKLERQITLSEIKYMEEIKTMQVETTEKNEALTAKMQEHTDLQHEKHELEQQLLEVRKELDGAYHTIVNQEEQASLREIKWDTFRIYSEDRLEAEQQRAEELELQVAALKQQLQEAEEEQVSLREVQWEGDQNHSLNELKSQRQYATDLEKQIEDLTQKLRSADAHYKQKATEERDKLAEITTEFSKLTHKVSKSVELEKKVQDLEQKLQLAYSKSDEQATDVLESRSREFSLDSLSSLVKQQDRTQAADKASPSPTLQEVQEPSGTMAFKFILGVALLSVLAGVFLGKRY

SEQ ID NO: 1747 - protein, 94 aa, Zea mays; identical to SEQ ID NO: 637

SEQ ID NO: 1748 - protein, 223 aa, Zea mays
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPCPCQQPHPSPCQLQGTCGVGSTPILGQCVEFLRHQCSPTATPYCSPQCQSLRQQCCQQLRQVEPQHRYQAIFGLVLQSILQQQPQSGQVAGLLAAQIAQQLTAMCGLQQPTPCPYAAAGGVPH

SEQ ID NO: 1749 - protein, 208 aa, Zea mays
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGLQANVQRLKTYKAKLVIFPRRAHKVKAGDSTPEELATATQVQGDYMPFTRGEKRSVEVVKVTDEMKSFAAYGKLRLERMNKKHLGARQKKAAEAEKEDKK

SEQ ID NO: 1750 - protein, 485 aa, Zea mays
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 1751 - protein, 544 aa, Zea mays
  MOD_RES (115)..(115): Any amino acid
  MOD_RES (274)..(274): Any amino acid
MALYLLFESASGYGLFHAYGIDEIGQSVEAVRSSVLDLDRFGKAVKLTAFNPFSSAVDALNQCNAYIRRIMTDELRSFLELNLPKPKEGKKAKYSLGVVEPKVGSHISEVTGIPXQSNEFVQELLRGVRLHFDRFINELKDSDLEKAQLGLGHSYSRAKVKFNVNRVDNMVIQAIFLLDTLDKDINSFSMRVREWFSWHFPELVKIVNDNYLYAKLAKFIVNKSDLTEKDIPALADIVGDEDKAKEIVEAAKASMGQDLSPVDLINVQQFAQRXMNLSEYRKNLYEYLVTKMNDIAPNLTSLIGEVVGARLISHAGSLSNLAKCAASTLQILGAEKALFRALKTRGNTPKYGLIFHSSFIGRASTKNKGRMARYLANKCSIASRIDCYSEASTSVFGQKLREQVEERLEFYDKGVAPRKNLDVMKAAIDSMVNGTSMDDDDIEKTDASPKKSKKKKTKTKADGDAMDVDKPSNVAGGEAEPGTEKKKKKKKHKLEEEAQEENGAADTTPKKKKKKSREASEEAEPKTATDGKKKKKKAKAEDDE

SEQ ID NO: 1752 - protein, 2366 aa, Zea mays
MWNGVPPPPPPPLQMAAAPPPPGTTVPGAGQPPPPPPPPAGASQGGKPLTPMELEAQLVEKARKWHQLNSKRYGDKRKFGFVEAQKEDMPPEHVRKITRDHGDMTSKKYRHDKRVYLGALKFVPHAVYKLLENMPMPWEQVRHVKILYHITGAITFVNEIPWVVEPIYLAQWGTMWIMMRREKRDRRHFKRMRFPPFDDEEPPLDYADNLLDVEPLEAIQLELDEEEDAAVYEWFYDHKPLMKTKLINGPSYRKWHLSLPIMATLYRLAGQLLSDLIDRNYFYLFDMESFFTAKALNMCIPGGPKFEPLYRDMEKGDEDWNEFNDINKLIIRQPLRTEYRIAFPHLYNNRPRKVKLGIYHTPMIMYIKTEDPDLPAFYYDPLINPITSTNKVDRRERKAAEEEDDEDFCLPEDVEPLLKQTELYTDTTAAGISLLFAPKPFNMRSGRTRRAEDIPLVSEWYKEHCPPAYPVKVRVSYQKLLKCYVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWVKPADSEPPPLLVYKWCQGINNLLDIWDTSDGQCVVMLQTKFEKFFEKIDLTLLNRLLRLVLDHNIADYVTAKNNVVLSYKDMSHTNSYGLIRGLQFASFVVQYYGLVLDLLILGLTRASEIAGPPQMPNEFLTYADTKVETRHPIRLYSRYIDKVHILFRFTHEEARDLIQRYLTEHPDPNNENMVGYNNKKCWPRDARMRLMKHDVNLGRSVFWDMKNRLPRSITTLEWENNFVSVYSKDNPNLLFSMCGFEVRILPKIRMTQEAFSNTKDGVWNLQNEQTKERTAIAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWTMSKPSLVSESKDVFDQKASNKYWIDVQLRWGDYDSHDVERYTRAKFMDYTTDNMSIYPSPTGVMIGIDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRIVLILRALHVNNEKAKMLLKPDKTIVTEPHHIWPTLNDEQWLKVECALRDLILSDYAKKNNVNTSALTQSEMRDIILGAEIAPPSQQRQQIAEIEKQSRETTQLTAVTTRTTNVHGDELIITTTSPYEQQAFASKTDWRVRAISATNLYLRVNHIYVNSDDIKETGYTYIMPKNILKKFICIADLRTQIAGFLYGLSPQDNPQVKEIRCIAMPPQHGTHQMVTLPANLPEHEFLNDLEPLGWMHTQPNEAPQLSPQDLTSHAKILENNKQWDGEKCIILTCSFTPGSCSLTAYKLTPSGYEWGRSNKDNGSNPHGYLPTHYEKVQMLLSDRFLGFYMVPDNAPWNFNFMGVKHDPQMKYNMKLGMPRDFYHEDHRPTHFLEFSNIEEGEAAEGDREDTFT

SEQ ID NO: 1753 - protein, 103 aa, Zea mays
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 1754 - protein, 135 aa, Zea mays; identical to SEQ ID NO: 575

SEQ ID NO: 1755 - protein, 155 aa, Zea mays
MASSSSSSHRRLILAAAVLLSVLAAASASAGTSCVPGWAIPHNPLPSCRWYVTSRTCGIGPRLPWPELKRRCCRELADIPAYCRCTALSILMDGAIPPGPDAQLEGRLEDLPGCPREVQRGFAATLVTEAECNLATISGVAECPWILGGGTMPSK

SEQ ID NO: 1756 - protein, 149 aa, Zea mays
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEK

SEQ ID NO: 1757 - protein, 221 aa, Zea mays
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNLHFVEAVALKPPEVTIDMAMQQQHEAELAAAAAQPLPDDDDDLIE

SEQ ID NO: 1758 - protein, 261 aa, Zea mays
MATDVAETPAPLVDAAPEAPADAPAAPAADAKPAKAKKATAPKKRASPTHPPYAEMVSEAITSLKERTGSSSYAIAKFVEDKHKDKLPPNFRKLLNVQLKKLVAGGKLTKVKNSYKLSSAATKPNPKPKAAPKKPKTGAKKPKAAAKTKAKTPAKAKPATKPKPAAKPKAVVKPKTPAKPKAKPAAKAKPKTAGAKPKPLAKKAGRPAKAAKTSAKDTPGKKAPVAKKSAAAAKKAPAKKAAPSKKAATPVRKAPSRKAKK

SEQ ID NO: 1759 - protein, 265 aa, Zea mays
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDSLGHQFATRMGNVFTIGKGNKPWVSLPKGKGIKLSIIEEQRKRDAAAQAAANA

SEQ ID NO: 1760 - protein, 304 aa, Zea mays
  source: /note="subsp. parviglumis"
MAETNPESSDLMAQTNKKIVPKFTEIFPVEDVNYPYSAFIASVRKDVIKHCTDHKGIFQPVLPPEKKVPELWFYTELKTRTSSITLAIRMDNLYLVGFRTPGGVWWEFGKNGDTHLLGDNPRWLGFGGRYQDLIGNKGLETVTMGRAEMTRAVNDLAKKKKMATLEEEEVQMQMQMPEAAELAAAAAAADPQADTKSKLVKLVVMVCEGLRFNTVSRTVDAGFNSQHGVTLTVTQGKQVQKWDRISKAAFEWADHPTAVIPDMKKLGIKDKNEAARIVALVKNQTTAAAAAATAASADNDDDEA

SEQ ID NO: 1761 - protein, 363 aa, Zea mays
MAAVDLTPRTPKKAYGGDGGAYYEWSPADLPMLSVASIGAAKLSLAAGGLSLPSYSDSAKVAYVLQGAGTCGLVLPEATKEKVVAVKEGDALALPFGAVTWWHNGPAAQADLTVLFLGDTSKGHKRGQFTNFQLTGSAGIFTGLSTEFVSRAWDLPEPDAARLVSSQPASGIVKLPASAAALPAPSPQDRAGVALNCLEAPLDVDIPGGGRVVVLNTANLPLVREVGLGADLVRIDAHSMCSPGFSCDSAYQVTYIVRGSGRVQVVGPDGRRVLETRIEGGSLFIVPRFHVVSKIADASGMEWFSIITTPNPVFSHLAGKTSVWKAISPEVLQASFNTTPEMEKLFRSKRLDSEIFFAPPSSN

SEQ ID NO: 1762 - protein, 411 aa, Zea mays
MAALSAPLRAVAAGSRVAASDPVKVSCVRSTGSAHFGCAFPYIRASSSAARNLEPLRAIATQAPPAMPQYSSGEKTKIGINGFGRIGRLVLRIATSRDDIEVVAVNDPFIDAKYMAYMFKYDSTHGPFKGSIRVVDDSTLEINGKKVTITSKRDPAEIPWGNFGAEYVVESSGVFTTTDKASAHLKGGAKKVVISAPSADAPMFVVGVNENSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKTASEGALKGILGYTDEDVVSNDFVGDSRSSIFDAKAGIGLSSSFMKLVSWYDNEWGYSNRVLDLIAHMALVSAKH

SEQ ID NO: 1763 - protein, 562 aa, Zea mays
MLVLFETPAGFALFKVLDEGKLDKVEDLWKEFTTSDSARKVVELKAFNKFENTSDALSAATLIIDSKPSKGLRKFLQKHCEGETLAVADSKLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRVNAVNLDFSEILSDEELETQLKEAAVISMGTEVSDLDLSNIRELCDQVLALSEYRAQLYDYLRSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLEGRELGKSAGSTKGKPKIEVYEKDRKKGTGALTTPAKTYNPAADLVLTEETPKKSELASKKRKHNEVETEPLAEPAEEAIQEDGDQEDRKKKKKKNKESKEAPAGEGDGEKKKKKKSKEVEEEPVVAAASEVKKKKKKSDADGEDVAMQTEESGKKEKKKKKKAC

SEQ ID NO: 1764 - protein, 79 aa, Zea mays; identical to SEQ ID NO: 551

SEQ ID NO: 1765 - protein, 136 aa, Zea mays
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 1766 - protein, 160 aa, Zea mays
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPK

SEQ ID NO: 1767 - protein, 149 aa, Zea mays
MEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 1768 - protein, 161 aa, Zea mays; identical to SEQ ID NO: 503

SEQ ID NO: 1769 - protein, 250 aa, Zea mays
MVKAYPTVNEDYLKAVDKAKRKLRGLIAEKNCAPLMLRLAWHSAGTFDVATKTGGPFGTMKNPAEQAHGANAGLEIAIRLLEPIKEQFPILSYADFYQLAGVVAVEVTGGPDVPFHPGRQDKPEPPPEGRLPDATQGSDHLRQVFSTQMGLSDQDIVALSGGHTLGRCHKDRSGFEGAWTSNPLIFDNSYFKELLSGEKEGLLQLPSDKALLSDPSFRPLVDKYAADEDAFFADYAEAHLKLSELGFAEA

SEQ ID NO: 1770 - protein, 260 aa, Zea mays
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSIGNVLPLRGIPEGAVVCNVEHHVGDRGVFARASGDYAIVISHNPDNGTSRIKLPSGAKKIVPSSCRAMIGQVAGGGRTEKPMLKAGNAYHKYRVKRNSWPKVRGVAMNPVEHPHGGGNHQHIGHASTVRRDAPPGQKVGLIAARRTGRLRGQAAATAAKADKA

SEQ ID NO: 1771 - protein, 332 aa, Zea mays
MAKEPMRVLVTGAAGQIGYALVPMIARGVMLGADQPVILHMLDIPPAAEALNGVKMELVDAAFPLLKGVVATTDVVEACTGVNVAVMVGGFPRKEGMERKDVMSKNVSIYKSQASALEAHAAPNCKVLVVANPANTNALILKEFAPSIPEKNVTCLTRLDHNRALGQISERLNVQVSDVKNVIIWGNHSSSQYPDVNHATVKTSTGEKPVRELVSDDEWLNGEFITTVQQRGAAIIKARKFSSALSAASSACDHIRDWVLGTPEGTFVSMGVYSDGSYGVPSGLIYSFPVTCSGGEWKIVQGLPIDEFSRKKMDATAQELTEEKTLAYSCLE

SEQ ID NO: 1772 - protein, 417 aa, Zea mays
MALVLHSGAGNKNAFKALIAAEYSGVKVELTKDFEMGVSNKTPEFLKMNPLGKVPVLETPDGPVFESNAIARYVARLKDDNPLFGSSRIEQAHVEQWMDFAATEVDPGVGWYLYPRLGYIPYAHTTEETAIASLKRSLGALNTHLALNTYLVGHSVTLADIVLTCNLYHGIARILTKSFTSDFPHVERYFWTMVNQPNFKKVIGEVKQAESVPPVLKKGVPPKESKAKDVKKETPKEAPKPKVVEVPAEEEAPKPKPKNPLDLLPPSKMVLDDWKRLYSNTKTNFREVAIKGFWDMYDPEGYSLWFCDYKYNDENTVSFVTLNKVGGFLQRMDLCRKYAFGKMLVVGSEPPFKLKGLWLFRGQEVPKFVMDEVYDMELYEWTKVDISDEAQKERVNAMIEDQEPFEGEALLDAKCFK

SEQ ID NO: 1773 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 1774 - protein, 482 aa, Zea mays
MAASVTVENLNPKVLKCEYAVRGEIVIHAQRLQQQLQTQPGSLPFDEILYCNIGNPQSLGQQPVTFFREVLALCDYPCLLEKEETKSLFSADAISRAKQILATIPGRATGAYSHSQGIKGLRDAIAAGIMSRDGFPANADDIFITDGASPGVHMMMQLLIRNEKDGILCPIPQYPLYSASIALHGGALVPYYLNEKTGWGLEISDLKMQLENARSKGIDVRALVVINPGNPTGQVLAEDNQYDIVKFCKNEGLVLLADEVYQENIYVDNKKFNSFKKIVRSMGYGEDDLPLVSLQSVSKGYYGECGKRGGYMEITGFSTPVREQIYKIASVNLCSNITGQILASLVMNPPKVGDESYASYKAEKDGILESLARRAKALEDAFNKLEGFSCNKAEGAMYLFPQIHLPQKAIEAAKAAKKAPDAFYALRLLESTGIVVVPGSGFRQVPGTWHIRCTILPQEDKIPAVISRFRAFHEAFLAEYRD

SEQ ID NO: 1775 - protein, 843 aa, Zea mays
MVKFTAEELRAIMDKKNNIRNMSVIAHVDHGKSTLTDSLVAAAGIIAQEVAGDVRMTDTRADEAERGITIKSTGISLYYEMTDESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDETKMMERLWGENFFDPATKKWTTKNTGSPTCKRGFVQFCYEPIKQIIKTCMNDQKEKLWPMLQKLNVTMKADEKELIGKALMKRVMQTWLPASTALLEMMIFHLPSPAKAQKYRVENLYEGPLDDVYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKETDACPIRAMKFSVSPVVRVAVQCKVASDLPKLVEGLKRLAKSDPMVLCTMEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSQILSQEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAFLPVIESFGFSSQLRAATSGQAFPQCVFDHWDMMGSDPLEAGSQAAQLVLDIRKRKGLKEQMTPLSEFEDKL

SEQ ID NO: 1776 - protein, 111 aa, Zea mays; identical to SEQ ID NO: 583

SEQ ID NO: 1777 - protein, 122 aa, Zea mays
MASEQGVVIACHSKAEFDAHMTKAQEAGKLVVIDFTAAWCGPCRAIAPLFVEHAKKFTQVVFLKVDVDEVKEVTAAYEVEAMPTFHFVKNGKTVATIVGAKKDELLALIEKHAAPAPASASA

SEQ ID NO: 1778 - protein, 130 aa, Zea mays
MATHRHCLPLLLVAAALALAAVPARAALGGGRGPLLGGWNPIPDVSDSHIQELGGWALGQAKHQKLAADGLRFRRVVRGEQQVVSGMNYRLYVDAADPAGRTVPYVAVVYEQVWTRTRQLASFNPVPRAP

SEQ ID NO: 1779 - protein, 139 aa, Zea mays
MANARSGVAVNDECMLKFGELQSKRLHRFITFKMDDKFKEIVVDQVGDRATSYDDFTNSLPENDCRYAIYDFDFVTAEDVQKSRIFYILWSPSSAKVKSKMLYASSNQKFKSGLNGIQVELQATDASEISLDEIKDRAR

SEQ ID NO: 1780 - protein, 145 aa, Zea mays
MTTRFKKNRKKRGHVSAGHGRIGKHRKHPGGRGNAGGMHHHRILFDKYHPGYFGKVGMRYFHKLRNKFYCPAVNIERLWSMVPADKAAEAGLDKAPQIDVTQFGYFKVLGKGVLPPKPIVVKAKLISKVAEKKIKAAGGAVVLTA

SEQ ID NO: 1781 - protein, 159 aa, Zea mays
MAEQTEKAFLKQPKVFLSSKKSGKGKKPGKGGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVVKVIPAGSAAAGKKAFTAA

SEQ ID NO: 1782 - protein, 152 aa, Zea mays; identical to SEQ ID NO: 568

SEQ ID NO: 1783 - protein, 180 aa, Zea mays; identical to SEQ ID NO: 513

SEQ ID NO: 1784 - protein, 178 aa, Zea mays
MVAFRFHQYQVVGRALPTPGDEHPKIYRMKLWATNEVRAKSKFWYFLRNLKKVKKSNGQVLAINEIFERNPTTIKNYGIWLRYQSRTGYHNMYKEYRDTTLNGAVEQMYNEMASRHRVRSPCIQIIKTATVHFKLCKRDNTKQFHNSEIKFPLVYRKVRPPTRKLKTTFKASRPNLFM

SEQ ID NO: 1785 - protein, 194 aa, Zea mays
MVHVNFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSIHHARVLIKQRHIRVGRQIVNVPSFMVRVESEKHIDFSLSSPFGGGPAGRVKRKNQKKASGGGDAGDEDEE

SEQ ID NO: 1786 - protein, 215 aa, Zea mays
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLAETDSKPEDKAIKINKPDQGSEAPAAQRSACCGS

SEQ ID NO: 1787 - protein, 220 aa, Zea mays
MGRRPARCYRQIKNKPCPKSRYCRGVPDPKIRIYDVGMKRKGVDEFPYCVHLVSWERENVSSEALEAARIVCNKYMTKSAGKDAFHLRVRVHPFHVLRINKMLSCAGADRLQTGMRGAFGKPQGTCARVDIGQVLLSVRCKDNNAAHASEALRRAKFKFPARQKIIESRKWGFTKFSRADYLKYKSEGRIVPDGVNAKLLANHGRLEKRAPGKAFLDAVA

SEQ ID NO: 1788 - protein, 251 aa, Zea mays
MAAAAAAATSFTTLAVARSAGQRSLLASKAAPSPLLSLRGARIPSQAVSFSGGLAASPSHSRARFATSASAEPKEADLQSKITNKVYFDISIGNPVGKNVGRIVIGLYGDDVPQTAENFRALCTGEKGFGYKGSSFHRVISDFMIQGGDFDKGNGTGGKSIYGRTFKDENFKLVHTGPGVVSMANAGPNTNGSQFFICTVKTPWLDGRHVVFGQVVEGMDIVRLIESQETDRGDRPKKKVVISECGELPVV

SEQ ID NO: 1789 - protein, 267 aa, Zea mays
MNMIRAVRRRFTVGHLATAKDPATLRHAAAELLATAIFVFAAEGATLSLGRMHHHDKGGGGLVAVALAHALALAAAVGCAANISGGHVNPAVTFGALLAGRICLVRSLVYWAAQLLGAVAAALVLRLATGGMHLPEYALAGGVSGWNAAVLEAAMAFGLMYAYFATVMDKARRVRAGAGALAAPLAVGLLAGANVLACGALEGAVMNPARAFGPAVVGSRRWRHQWVYWVGPMVGAGLSGVVYEHLVAGPAAEEEEPAPSCGDRRRA

SEQ ID NO: 1790 - protein, 260 aa, Zea mays
MAVGKNKRISKGKKGGKKKTVDPFSKKDWYDIKAPSVFSVRNIGKTLVSRTQGTRIASEGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKRTCYAQASQIRQIRRKMVEIMINQASTCDLKELVSKFIPEVIGKEIEKSTSSIFPLQNVFIRKVKILKAPKFDLGKLMEVHGDYKEDVGVKLERPVEGDEAGQEVAAAE

SEQ ID NO: 1791 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGYSTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 1792 - protein, 508 aa, Zea mays
MEFSPRAAELTTLLESRMINFYTNLKVDEIGRVVSVGDGIARVYGLNEIQAGEMVEFASGVKGIALNLENENVGIVVFGSDTAIKEGDLVKRTGSIVDVPAGKAMLGRVVDALGVPIDGKGALSDHERRRVEVKAPGIIERKSVHEPMQTGLKAVDSLVPIGRGQRELIIGDRQTGKTAIAIDTILNQKQMNSRGTNESETLYCVYVAIGQKRSTVAQLVQILSEANALEYSMLVAATASDPAPLQFLAPYSGCAMGEYFRDNGMHALIIYDDLSKQAVAYRQMSLLLRRPPGREAFPGDVFYLHSRLLERAAKRSDQTGAGSLTALPVIETQAGDVSAYIPTNVISITDGQICLETELFYRGIRPAINVGLSVSRVGSAAQLKAMKQVCGSSKLELAQYREVAAFAQFGSDLDAATQALLNRGARLTEVPKQPQYEPLPIEKQIVVIYAAVNGFCDRMPLDRISQYEKNILSTINPELLKSFLEKGGLTNERKMEPDASLKESALNL

SEQ ID NO: 1793 - protein, 553 aa, Zea mays
MASRRVVSSLLRSASRLRAASPAAPRPRAPPHRPSPAGYLFNRAAAYASSAAAQAAPATPPPATGKTGGGKITDEFTGAGAIGQVCQVIGAVVDVRFDEGLPPILTALEVLDNNIRLVLEVAQHLGENMVRTIAMDGTEGLVRGQRVLNTGSPITVPVGRATLGRIINVIGEPIDEKGDIKTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLDDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVKSFQGVLDGKYDDLPEQSFYMVGGIEEVIAKAEKIAKESAS

SEQ ID NO: 1794 - protein, 799 aa, Zea mays
MAFRVSGAVLGGAVRAPRLTGGGEGSLVFRHTGLFLTRGARVGCSGTHGAMRAAAAARKAVMVPEGENDGLASGADSAQFQSDELEVPDISEETTCGAGVADAQALNRVRVVPPPSDGQKIFQIDPMLQGYKYHLEYRYSLYRRIRSDIDEHEGGLEAFSRSYEKFGFNRSAEGITYREWAPGAFSAALVGDFNNWDPNADRMSKNEFGVWEIFLPNNADGTSPIPHGSRVKVRMDTPSGIKDSIPAWIKYSVQAPGEIPYNGIYYDPPEEVKYVFRHAQPKRPKSLRIYETHVGMSSPEPKINTYVNFRDEVLPRIKKLGYNAVQIMAIQEHSYYGSFGYHVTNFFAPSSRFGTPEDLKSLIDRAHELGLLVLMDVVHSHASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVDAVVYLMLVNDLIHGLYPEAVTIGEDVSGMSTFALPVHDGGVGFDYRMHMAVADKWIDLLKQSDETWKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDLGDADYLRYHGMQEFDQAMQHLEQKYEFMTSDHQYISRKHEEDKVIVFEKGDLVFVYNFHCNNSYFDYRIGCRKPGVYKVVLDSDAGLFGGFSRIHHAAEHFTADCSHDNRPYSFSVYTPSRTCVVYAPVE

SEQ ID NO: 1795 - protein, 120 aa, Zea mays; identical to SEQ ID NO: 579

SEQ ID NO: 1796 - protein, 123 aa, Zea mays; identical to SEQ ID NO: 578

SEQ ID NO: 1797 - protein, 156 aa, Zea mays
MADHHRGATGGGGGYGDLQRGGGMHGEAQQQQKQGAMMTALKAATAATFGGSMLVLSGLILAGTVIALTVATPVLVIFSPVLVPAAIALALMAAGFVTSGGLGVAALSVFSWMYKYLTGKHPPGADQLDHAKARLASKARDIKDAAQHRIDQAQGS

SEQ ID NO: 1798 - protein, 154 aa, Zea mays
MDARMFGLETPRVAALHHLLDVPDGDKAGGGATRTYVRDARAMAATPADVKELAGAYAFVVDMPGLSTGDIRVQVEDERVLVISGERRREEREDAKYLRMERRMGKFMRKFVLPDNADVDKVAAVCRDGVLTVTVEKLPPPEPKKPKTIEIKVA

SEQ ID NO: 1799 - protein, 148 aa, Zea mays
MTLGSSGAGSSVVVPRNFRLLEELERGEKGIGDGTVSYGMDDADDIYMRSWTGTIIGPHNTVHEGRIYQLKLFCDKDYPEKPPSVRFHSRINMTCVNHETGMVDPRKFGLLANWQRDYTMENILTQLKKEMAASQNRKLVQPPEGTFF

SEQ ID NO: 1800 - protein, 168 aa, Zea mays
MAASSTATSVHDFIVKDASGKDVDLSTYKGKVLLIVNVASQCGLTNSNYTELAQLYEKYKDQGFEILAFPCNQFGGQEPGTNKEIVQFACTRFKAEYPIFDKVDVNGSNAAPIYKFLKSSKGGLFGDSIKWNFSKFLVDKEGRVVDRYAPTTSPLSIEKDIKKLLGSS

SEQ ID NO: 1801 - protein, 208 aa, Zea mays
  MOD_RES (119)..(119): Any amino acid
MASDRVLGTVKWFNGTKGFGFITPDDGSEDLFVHQSSIKSDGYRSLNDGDAVEYTVGSGNDGRAKALDVTAPGGGPLAGGERPDGGNGGGRGGYGGGDRGYGGGGDRGYGGGGDRGYGXGDRGYGGGGDRGYGGDRGYGGGGGYGGGYGGGGGGGGRGCFKCGEEGHMARDCSQGGGYGGGGGGGRGSECYNCGQEGHISRDCPNKRR

SEQ ID NO: 1802 - protein, 187 aa, Zea mays
MGIDLVAGGRNKKTKRTAPKSDDVYLKLLVKLYRFLVRRTKSNFNAVILKRLFMSKTNRPPLSMRRLVRFMEGKGDQIAVIVGTVTDDKRISEVPAMKVCALRFTETARARIINAGGECLTFDQLALRAPLGQNTVLLRGPKNAREAVRHFGPAPGVPHSHTKPYVRSKGRKFEKARGRRNSRGFKV

SEQ ID NO: 1803 - protein, 226 aa, Zea mays; identical to SEQ ID NO: 651

SEQ ID NO: 1804 - protein, 229 aa, Zea mays; identical to SEQ ID NO: 851

SEQ ID NO: 1805 - protein, 232 aa, Zea mays
MASTHAISKKRKFVADGVFFAELNEMLTRELAEDGYSGVEVRVTPMRTEIIIRATRTQNVLGEKGRRIRELTSVVQKRFNFPEGGVELYAEKVNNRGLCAIAQAESLRYKLLGGLAVRRACYGVLRFVMESGAKGCEVIVSGKLRAQRAKSMKFKDGYMISSGHPVNLYIDSAVRHVLLRQGVLGIKVKIMLDWDPKGKQGPTMPLPDLVTIHVPKEEDEFLRPLAAEIQVA

SEQ ID NO: 1806 - protein, 241 aa, Zea mays
MAANLEDVPSLDLMHELLRRMKCSSKPDKRLILIGPPGSGKGTQSPIIKDEYCLCHLATGDMLRAAVAAKTPLGIKAKEAMNKGELVSDDLVVGIIDEAMKKPSCQKGFILDGFPRTVTQAQKLDEMLAKQGANVDKVLNFAIDDAVLEERITGRWIHSASGRTYHSKFAPPKSPGVDDVTGEPLIQRRDDTAEVLKSRLEAFHRQTEPVIDYYSKKGLVVNLPAEKPPKEVTAEVQKALS

SEQ ID NO: 1807 - protein, 257 aa, Zea mays
MAPKRGGRAPVPAKKKAVVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVESKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 1808 - protein, 290 aa, Zea mays
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 1809 - protein, 274 aa, Zea mays
MAERGGERGGERGGFGRGFGRGGRGDRGGRRGGRRGPRQEEEKWVPVTKLGRLVKENRITKIEEIYLHSLPVKEHQIIETLVPGLKDEVMKITPVQKQTRAGQRTRFKAFVVVGDCDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWSQTKFSMTPFQQYTDLLAKPTKGLVLEAPTETVEA

SEQ ID NO: 1810 - protein, 308 aa, Zea mays
MADAKQQQQQPQQAAAAATGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLIQKAFIGLTAGAIGACFGSPADLALIRMQADSTLPAAQRRNYKNAFHALYRISADEGVLALWKGAGPTVVRAMALNMGMLASYDQSVELFRDKFGAGEISTVVGASAVSGFFASACSLPFDYVKTQIQKMQPDANGKYPYTGSLDCAVKTFKSGGPFKFYTGFPVYCVRIAPHVMMTWIFLNQIQKFEKKIGI

SEQ ID NO: 1811 - protein, 302 aa, Zea mays
MGGFVKTHKSNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDE

SEQ ID NO: 1812 - protein, 319 aa, Zea mays
MAIKRTKAEKKIAYDKKLCSLLDEYTKVLIALADNVGSKQLQDIRRGLRGDSVVLMGKNTLIRRCIKVYAEKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGEKVGSSESALLAKLGIRPFSYGLQVTSVYEDGSVFSPEVLDLSEEDLIEKFATGVSMVASLSLAISYPTLAAVPHMFINGYKNVLAVAVETDYSYPHADKIKEYLKDPSKFAVAAPVAAGDSGASAAPKEEEKAAEPEEESDEEMGFSLFDD

SEQ ID NO: 1813 - protein, 380 aa, Zea mays
MWNLNKALVTSLLCISALSSSPWPCTAAGQLGGKPLVTAVTKDASTSLYTAPLKDGHPLVLDLTSPVISLATCASSSKNNNGTLTATLSANATDGQNPLFPVSFSAVATCAPSSKLPAGAGAVGVAGLAPSSSSQQSLPAQVARTQKVADKVALCLPSDGRSTSGDSVGVAIFGGGPLFFVPPDRGDFTTMLAGTAPLHAGAGAGAPGYYVSSTGIAVEQARVGGPRGALVVALSSTVPYTALRPDVYAPFVKAFDAAAAGPNFPWMSRVAAVAPFDRCYDSTKLPQSLLGYAVPQIDVMLEGGQNFTVLGGNSMVQVNANTACLGFVQAPGQAPAAVIGGFQLENHLLLLDVDKKQLGFTTFLNAIGLSCSSFNFTLAS

SEQ ID NO: 1814 - protein, 387 aa, Zea mays
MADQANQPTVLHKLGGQFHLRSIISEGVRARNICPSVSSYERRFATRNYMTQSLWGPSMSVSGGINVPVMQTPLCANAPAEKGGKNFMIDFMMGGVSAAVSKTAAAPIERVKLLIQNQDEMIKSGRLSEPYKGIVDCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 1815 - protein, 374 aa, Zea mays
MAIPLVLVVLPLGLLFLLSGLIVNAIQAVLFVTIRPFSKSFYRRINRFLAELLWLQLVWVVDWWAGVKVQLHADEETYRSMGKEHALIISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDEDVSKWCKDIFVAKDALLDKHLATGTFDEEIRPIGRPVKSLLVTLFWSCLLLFGAIEFFKWTQLLSTWRGVAFTAAGMALVTGVMHVFIMFSQAERSSSARAARNRVKKE

SEQ ID NO: 1816 - protein, 397 aa, Zea mays
MQSTAAIGLVRPCAARPLPTYPSPRRGAGACSGAAQPILAPRGLCLSARASLLPDSPLEEEYRRCRAGRHVAAAGKVAAADGAVEEAGGGLVKTLQLGSLFGLWYLFNIYFNIYNKQVLKVLPYPINITTVQFAVGSAIALFMWITGILKRPKISGAQLFAILPLAIVHTMGNLFTNMSLGKVAVSFTHTIKAMEPFFSVLLSAIFLGELPTPWVVLSLLPIVGGVALASLTEASFNWAGFWSAMASNVTFQSRNVLSKKLMVKKEESLDNINLFSIITVMSFFLLAPVTLLTEGVKVSPAVLQSAGLNLKQIYTRSLIAACCFHAYQQVSYMILARVSPVTHSVGNCVKRVVVIVTSVLFFRTPVSPINSLGTGIALAGVFLYSQLKRLKPKPKAA

SEQ ID NO: 1817 - protein, 394 aa, Zea mays
MFYSEEAMIPSVRLSPGPAAFSGSSLRSKLPSIPSISSLKPSKYVVSSLKPLYLAPLDGPRTAELKSRRQPLEFRCSASAADDKESKTQVVPVQSEGAQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFSVLVSRFFLGETFPIPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWIAAQSVFYHLYNQVSYMSLDQISPLTFSIGNTMKRISVIVSSIIIFHTPVRAVNALGAAIAILGTFLYSQAKA

SEQ ID NO: 1818 - protein, 415 aa, Zea mays
MAASNGEGHGRFDVIVVGAGIMGSCAAYAASSRGARVLLLERFDLLHHRGSSHGESRTIRATYPQAHYPPMVRLSRRLWDEAQADAGYTVLTPTPHLDLGPRDDSALVASMRNGGATEVVAGDESSSWPWAGVFRVPDGWTAARSELGGVMKATKAVAMFQALAVKRGAVLRDRTEVVDITSSKRGEGEGSIISVRTSSGEEFHGTKCIVTVGAWTSKLIKSVTGLELPVQPVHTLICYWKVRPGREQELTPEAGFPTFASYGDPYIYSTPSMEFPGLIKIAMHGGPPCDPDGRDWSTGAGDLVEPVARWIDAVMPGHVDTTGGPVVRQCCMYSVTPDDDYVVDFLGGEFGKDVVIGAGFSGHGFKMGPAVGRILAEMALDGEASTAAEAGVDLRPLTIGRFAGNPKGNLSASQG

SEQ ID NO: 1819 - protein, 393 aa, Zea mays
MPPKAKKDAAPSERPILGRFSSHLKIGIVGLPNVGKSTFFNIVTKLAIPAENFPFCTIEPNEARVNVPDERFDWLCKLYKPKSEVPAYLEVTDIAGLIRGAHAGDGLGNAFLSHIRAVDGIFHVLRAFEDAEITHVDDTVDPVRDMETISEELRLKDIEFMKKKLEDLDKSMKRSNDKQLKIEHELCERVIGHLEEGKDVRLGDWKAADIEILNTFQLLSAKPVVYLVNMSEKDFQRKKNKFLPKIHAWVQEHGGETILPFSCAFEQKLVDMPEDEAAKYCAENQITSMIPKIIKTGFAAIHLIYFFTAGPDEVKCWQIRRQTKAPQAAGAIHTDFERGFICAEVMKFEDLKELGSESAVKAAGKYKQEGKTYVVQDGDIIFFKFNVSGGGKK

SEQ ID NO: 1820 - protein, 431 aa, Zea mays
MAGRESGGMAAALRCAGRIGILATVAVNLAWIATYIRRRYFGGGNRSDNNGGGGEVEPSRGKPPVTSDSIVNLDHGDPTMYEEFWRGTGDSASIFIPGWQTMSYFSDLGGICWFLEPGFEREVRRLHRLVGNAVVDGYHVLVGTGSTQLFQAVLYALSPASDGTPMNVVSPAPYYSSYPSVTNYLNSALYRWAGDANTFDGDTCIELVCSPNNPDGGLRKPVIKSKSSKPVYDFAYYWPQYTPITEAAAHDIMLFTVSKCTGHAGTRLGWALVKDTKVAQKMIKFIELNTIGVSKDSQLRAAKIIGAICNGYEPVPSSGKTSQLFHFAKEKMAARWARLRAAVAASDIFTLPYELSGYCSFSNETVTANPPFAWLRYNKDDIEDLEAFLLEKKIITRGGTRFGVDARAVRVSMVDTDQAFNVFINRLATMK

SEQ ID NO: 1821 - protein, 473 aa, Zea mays
MATTAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVNGPEDL

SEQ ID NO: 1822 - protein, 475 aa, Zea mays
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQLLYRKYSGNFLVNLLGMWKESEYSGHSVPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGF

SEQ ID NO: 1823 - protein, 475 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDENARIGDNVKILNADNVQEAAMETDGYFIKGGIVTVIKDALLPSGTVI

SEQ ID NO: 1824 - protein, 565 aa, Zea mays
MGSTAAVSVSASAIASRGCARSEAARRPGGIRVCGLRSEALTCHSLRISQAPARLMVTRPPPPAAATNGAAAGSCGFDYDLVIIGAGVGGHGAALHAVEEGLKTAIIEGDVVGGTCVNRGCVPSKALLAVSGRMRELHDEHHMKSLGLQVSSPGYDRQAVADHANNLASKIRINLTNSMKALGVDILTGVGTIVGKQKVRYGKAGFPDKEITARNIIIATGSVPFVPKGIEIDGKTVFTSDHALKLESVPDWIAIVGSGYIGLEFSDVYTALGSEVTFVEALDQLMPGFDPEIAKLAQRVLINPRKIDYHTGVFASKITPAKDGKPVLIELIDAKTKEHKETLEVDAALIATGRAPFTKGLGLENINVVTQRGFVPVDERMRVMDAGGNVVPNLYCIGDANGKLMLAHAASAQGISVVEQISGKDHILNHLSIPAACFTHPEISMVGLTEPQAREKADKEGFEVNVVKTSFKANTKALAENEGDGIAKLIYRPDTGEILGVHILGLHAADLIHEASNAIALGTRVQDIKFAVHAHPTLSEVLDELFKAAKVNSGVSHSVNEPVAA

SEQ ID NO: 1825 - protein, 72 aa, Zea mays; identical to SEQ ID NO: 646

SEQ ID NO: 1826 - protein, 84 aa, Zea mays; identical to SEQ ID NO: 592

SEQ ID NO: 1827 - protein, 124 aa, Zea mays
MAMDPDAVAKAFVEHYYRTFDTNRAALVGLYQETSMLTFEGQKFQGPSAIAGKLGSLPFQACEHQIVTVDCQPSGPQGGMLVFVSGSIRTGPEEHPIKFSQAFHLLPAAGSFFVQNDMFRLNYG

SEQ ID NO: 1828 - protein, 135 aa, Zea mays
MAGRGKAIGSGAAKKATSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKAGGGSAKAAAGDED

SEQ ID NO: 1829 - protein, 132 aa, Zea mays; identical to SEQ ID NO: 556

SEQ ID NO: 1830 - protein, 146 aa, Zea mays
MATAAAQGGSDKPALRKPVFTKVDQLKPGTNGHTLTVKVVSATPVPGRARPGAPAAASSRAPRIAECLVGDETGVIVFTARNDQVDLLKPDATVILRNAKIDMFKGSMRLAVDKWGRIEATEPASFTVKEDNNLSLVEYELVNVAE

SEQ ID NO: 1831 - protein, 149 aa, Zea mays
MSRRKTREPKEENVLGPTVREGEFVFGVAHIFASFNDTFIHVTDLSGRETLVRITGGMKVKADRDESSPYAAMLAAQDVAQRCKELGITALHIKLRATGGNKTKTPGPGAQSALRALARSGMKIGRIEDVTPVPTDSTRRKGGRRGRRL

SEQ ID NO: 1832 - protein, 145 aa, Zea mays
MAESTARTVKDVNPHEFVKAYSAHLKRSGKMELPEWVDIVKTARFKELPPYDPDWYYIRAASIARKIYLRQGIGVGGFQKIYGGRQRNGSRPPHFCKSSGAVARNILQQLQIMGIIDVDPKGGRLITNQGRRDLDQVAGRVAVEA

SEQ ID NO: 1833 - protein, 165 aa, Zea mays
METAAVAASSAGRRIMVAVDEGEESLHALNWCLANVVSPAGGDTLVLVHARRPRPVYAAMDSAGYMMTSDVLASVERHANAVSAAAVDKAKRVCADHPHVKVETTVESGDPRDVICDAANKMAADLLVMGSHGYGFIQRAFLGSVSNHCAQNCKCPVLIVKRPKE

SEQ ID NO: 1834 - protein, 149 aa, Zea mays
MSTVLQRPTPGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFTRYDRTLLVADPRRCEPKKFGGRGARARFQKSYR

SEQ ID NO: 1835 - protein, 158 aa, Zea mays
MSLIRRSNVFDPFSLDLWDPFEGFPFGSGNSSSLFHSFPRTSSETAAFAGARIDWKETPEAHVFKADVPGLKKEEVKVEVEDGNVLQISGERNKEQEEKTDTWHRVERSSGRFLRRFRLPENAKTEQITAAMENGVLTVTVPKEDAKKPEVKSIQISG

SEQ ID NO: 1836 - protein, 183 aa, Zea mays; identical to SEQ ID NO: 519

SEQ ID NO: 1837 - protein, 179 aa, Zea mays; identical to SEQ ID NO: 499

SEQ ID NO: 1838 - protein, 182 aa, Zea mays
  MOD_RES (15)..(15): Any amino acid
  MOD_RES (17)..(17): Any amino acid
MPAGHGLRSRTRDLXAXPFRKKGYIPLTTYLRTYKIGDYVDVKVNGAVHKGMPHKFYHGRTGRVWNVTKRAIGVEVNKQVNGRIIRKRIHVRVEHVQPSRCTEEFRLRKAKNDQLKADAKKRGEVISTKRQPLGPKPGFMVEGTTIETVTPIPYDVVNDLKGGILGCLVHLPAVPSSTSVLL

SEQ ID NO: 1839 - protein, 181 aa, Zea mays
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATTGEGLYEGLDWLSSNIATKS

SEQ ID NO: 1840 - protein, 214 aa, Zea mays
MAPMKLYGAVMSWNLTRCATALEEAGSDYEIVPINFATAEHKSPEHLVRNPFGQVPALQDGDLYLFESRAICKYAARKNKPELLREGNLEEAAMVDVWIEVEANQYTAALNPILFQVLISPMLGGTTDQKVVDENLEKLKKVLEVYEARLTKCKYLAGDFLSLADLNHVSVTLCLFATPYASVLDAYPHVKAWWSGLMERPSVQKVAALMKPSA

SEQ ID NO: 1841 - protein, 219 aa, Zea mays
MAPTSKLSTGIKRASRSHAYHRRGLWAIKAKNGGAFPKADKAAAAVEPKFYPADDVKPRVPSTRKPKPTKLRSSITPGTVLILLAGRFMGKRVVFLKQLKSGLLLISGPFKINGVPIRRVNQTYVIATSTKVDISGVDVAKFDDKYFAREKKQKVKKTEGELFETEKEASKSLPDFKKDDQKAVDSALIKAIEAVPELKTYLGARFSLRDGDKPHEMVF

SEQ ID NO: 1842 - protein, 206 aa, Zea mays
MVSGSGVCAKRIVVDARHHMLGRLSSIIAKELLNGQKVVVVRCEEICMSGGLVRQKMKYLRFLRKRMNTKPSHGPIHFRAPAKILWRTIRGMIPHKTKRGEAALARLKTYEGVPPPYDKTKRMVIPDALKVLRLQPGHKYCLLGELSKEVGWNYHDTIRELEEKRKEKAKVAYERKKQLAKLRVKAEKAAEEKLGSQLEILAPIKY

SEQ ID NO: 1843 - protein, 216 aa, Zea mays
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAEREMTFFMETSALESMNVESAFTEVLTQIYRVVSKKALDIGDDPAAPPRGQTINVGGKDDVSAVKKAGCCSS

SEQ ID NO: 1844 - protein, 214 aa, Zea mays
MSEEDKAAASAEQPKRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVVPGSFLRARAIGLMPMIDQGEKDDKIIAVCADDPEYRHYNDISELSPHRLQEIKRFFEDYKKNENKEVAVDAFLPATTAQEAIQYSMDLYAQYILQSLRQ

SEQ ID NO: 1845 - protein, 229 aa, Zea mays
MPGLTIGDTVPNLELDSTHGKIRIHDYVGDGYAIIFSHPADFTPVCTTEMAAMAGYAKEFEKRGVKLLGISCDDVESHRQWTKDVEAYGGKQQQQQATTTKVTFPILADPARDAIRQLNMVDPDEKDAAGRSMPSRALHVVGPDKAVKLSFLYPATTGRNMDEVLRAVDSLLTAAKHGGKVATPANWKPGECAVIAPGVSDEEARKMFPQGFETADLPSKKGYLRFTKV

SEQ ID NO: 1846 - protein, 233 aa, Zea mays
MALRTLASKNALSFALGGAARPSAASARGVTTVALPDLSYDFGALEPAISGEIMRLHHQKHHATYVGNYNKALEQLDAAVAKGDASAVVQLQGAIKFNGGGHVNHSIFWKNLKPISEGGGEPPHGKLGWAIDEDFGSFEALVKRMNAEGAALQGSGWVWLALDKEPKKLSVETTANQDPLVTKGASLVPLLGIDVWEHAYYLQYKNVRPDYLNNIWKVMNWKYAGEVYENVLA

SEQ ID NO: 1847 - protein, 238 aa, Zea mays
MLAVFSGQVVEVPAELVAAGSRTPSPKTKASQLVGRFLAASEPAVSVQLGDHGHLAYSHTNQALLRPRSFAAKDEVFCLFEGVLDNLGRLSQQHGLSSKGANEVLLVIEAYKTLRDRAPYPASFMLAQLTGSYAFVLFDKSTNSLLVASDPEGRVPLFWGITADGCVAFSDDIDMLKGSCGKSLAPFPQGCFYSNALGGLKCYENPKHKVTAVPADEEEICGATFKVVEGSTVLTALH

SEQ ID NO: 1848 - protein, 246 aa, Zea mays
MSFVQLSGAGVAAVAFTNKSLVSRHAALRVCSSRRSIRSLVVKAATVVTPKYTSLKPLGDRVLVKLGAAEEKTVGGILLPSTAQTKPQGGEVVAVGAGRTIGDKKIAVDIETGAQVVYSKYAGTEVEFNDSKHLILKEDDIIGILETDDVKDMKPLNDRVLIKVAEAEDKTPGGLILTETTKEKPSIGTVVAVGPGPLDEEGKRQPLSVSAGSTVLYSKYAGSEFKGADGTAYIVLRASDVMAVLS

SEQ ID NO: 1849 - protein, 238 aa, Zea mays
MSAASKKLFQAARSLVLSASNRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 1850 - protein, 269 aa, Zea mays
PQLVALGLALLCAVAGPAAAQNCGCQPNVCCSKFGYCGTTDEYCGDGCQSGPCRSGRGGGGSGGGGANVASVVTSSFFNGIKNQAGSGCEGKNFYTRSAFLSAVKGYPGFAHGGSQVQGKREIAAFFAHATHETGHFCYISEINKSNAYCDPTKRQWPCAAGQKYYGRGPLQISWNYNYGPAGRAIGFDGLGDPGRVARDAVVAFKAALWFWMNSVHGVVPQGFGATTRAMQRALECGGNNPAQMNARVGYYRQYCRQLGVDPGPNLTC

SEQ ID NO: 1851 - protein, 244 aa, Zea mays
MSSEAVKVAVPESVLRKRKREEQWAAEKKEKSLAERKKSIENRKLIFTRAKQYAEEYDAQEKELVQLKREARLKGGFYVSPEAKLLFVIRIRGINAMHPKTRKILQLLRLRQIFNGVFLKVNKATINMLRRVEPYVAYGYPNLKSVRELIYKRGYGKLNKQRIPLSNNQVIEEGLGKHNIICIEDLVHEIMTVGPHFKEANNFLWPFKLKAPLGGLKKKRNHYVEGGDAGNRENYINELIKRMN

SEQ ID NO: 1852 - protein, 303 aa, Zea mays
MQGLAPPTSVSIHRHLPARSRARASNSVRFSPRAVSSVPPAECLQAPFHKPVADLPAAARQRGTVKWFNDTKGFGFISPEDGSEDLFVHQSSIKSEGFRSLAEGEEVEFSVSEGDDGRTKAVDVTGPDGSFVRGGGGGGGGGGGYGSRGGGGSGGGGRSYGGSWGGGRRSGGGGGPGACYKCGEPGHMARDCPSADGGGGYGGGGYGGGGYGGGGGGGGGCFKCGEPGHMARDCSSGGGGYGGGGGGGGGGCYNCGQAGHMARDCPSGGGSGGGRFGGGGGGGGDRSCYNCGEAGHIARDCPT

SEQ ID NO: 1853 - protein, 303 aa, Zea mays
MGGSGRAALLLALVAVSLAVEIQADAGYGYGGGYTPTPTPATPTPKPEKPPTKGPKPDKPPKEHKPPKEHGPKPEKPPKEHKPTPPTYTPSPKPTPPTYTPTPPPTPKPTPPTYTPAPTPHKPTPKPTPTPPTYTPSPKPPTPKPTPPTYTPSPKPPATKPPTPKPTPPTYTPSPKPPTPKPTPPTYTPSPKPPTPKPTPPTYTPSPKPPTPKPTPPTYTPSPKPPATKPPTPKPTPPTYTPSPKPPTPKPSPPTYTPSPKPPTPKPTPPTYTPTPKPPATKPPTYTPTPPVSHTPSPPPPYY

SEQ ID NO: 1854 - protein, 311 aa, Zea mays
MAARCPYFAVEESSRGIRSGESPAAALRRILATPGAHQAPCCYDALGARLVERAGFPIGFMGGFCVSAARLGLPDVGLISYGEMVDQGRLINEAVSIPVIGDGDNGYGNSMNIKRTIKGYINAGFAGIMLEDQVAPKACGHTEGRKVISREEAVMHIKAAVDARKESGSDIVIVARTDSRQAISHDEALWRVKAFADAGADVLFIDALASVEEMKAFCAVAPEVPKMANMLEGGGKTPILSPAELEEIGFRLVVYPLSLVGVSMRAMQDALVAIKDGGVPPPSVLPSFQEIKDTLGFNRYYKEEKQYQVDK

SEQ ID NO: 1855 - protein, 335 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 1856 - protein, 340 aa, Zea mays
MRPSLMRSTSQLLRRRSYSSASGQPERKVAILGAAGGIGQPLSLLMKLNPLVSSLSLYDIAGTPGVAADVSHINSPALVKGFMGDEQLGEALEGSDVVIIPAGVPRKPGMTRDDLFNINAGIVKNLSTAIAKYCPNALVNMISNPVNSTVPIAAEVFKKAGTYDEKKLFGVTTLDVVRAKTFYAGKANLPVTDVNVPVVGGHAGITILPLFSQATPATNALSDEDIKALTKRTQDGGTEVVEAKAGKGSATLSMAYAGAVFADACLKGLNGVPDIVECSFVQSTVTELPFFASKVRLGKNGVEEVLGLGELSDFEKEGLEKLKSELKSSIEKGIKFANDN

SEQ ID NO: 1857 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSIMRAALECSDKGWGTSVIVGVAASGQEISTRPFQLVTGRVWKGTAFGGFKSRTQVPWLVDKYMKKEIKVDEYITHNMNLADINDAFHLLHEGGCLRCVLAMQI

SEQ ID NO: 1858 - protein, 425 aa, Zea mays
MAAAATTPHSLLLQRAAIPAAPSRASAAASPVRLPVRAARISCAAVAAPSPAAAAAADEVERGVYNFAAGPATLPLSVLKRAQAELVDYHGSGMSIMEMSHRGKEFDAAIKKAESDLRALLAVPDTHAVLFLQGGATTQFAAVPLNLCTGPSDPADFVVSGSWSDKAFKEAKKFSAASVAWSGKDGKYTALPPFDAIAQNPEARFLHICSNETIHGVEFKDYPEPRNRSGILVADMSSNFCSKPVDVSRFGVIYAGAQKNVGPSGVTIAIVRKDLIGAAQPITPVMLDFKTHADNASLYNTPPCFAIYVCGLVFEDLLAQGGLAEVEKKNARKAGALYDTIDASGGYYVCPVDKSVRSHMNVPFTLAKGPDFEKQFIAEAAKEGMVQLKGHRSVGGVRASIYNAMPLAGVEKLVAFMKDFQARNP

SEQ ID NO: 1859 - protein, 461 aa, Zea mays
MQSLLLPTAAVAPVAPPCGRRNLPGRLSVRASATVVAAPRRETDPKKRVVITGMGLVSVFGNDVDAYYDRLLVGESGIGPIDRFDASKFPTRFAGQIRGFSSEGYIDGKNDRRLDDCLRYCIVSGKKALEASGIAHGSKPMEKIDKTRAGVLVGTGMGGLTVFSDGVQNLIEKGYRKITPFFIPYAITNMGSALLGMDIGFMGPNYSISTACATSNYCFYAAANHIRRGEADIMIAGGTEAAIIPIGVGGFVACRALSQRNDDPKTASRPWDKDRDGFVMGEGAGVLVMESLEHAMKRDAPIIAEYLGGAVNCDAYHMTDPRSDGLGVSSCIKQSLKDAGVAPEEVNYINAHATSTLAGDLAEVNAIKQVFKDPSGIKINATKSMIGHCLGAAGGLEAIATIKAITTGWVHPSINQFNPEEAVEFDTVPNVKKQHEVNVGISNSFGFGGHNSVVVFAPFKP

SEQ ID NO: 1860 - protein, 559 aa, Zea mays
MGSSGFSWTLPDHPKLPKGKSVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 1861 - protein, 593 aa, Zea mays
MSEQQQPLPQPRSSMREALEKEDKEKAAAAAAAKEKAAVPKNGNGNGGKNGGGAGSGNGGAPPQSGEETAREIQVVREAYRRETAAPAYVIPEEPPAVVELVGWYIYGFCSYFITHLLLPVLFPAIITQVAFPNSDFTPDPKYTLKGVTCSVHEMSMYQRLTKHSIVIDGSRMSPLGWSGLSWAIGILIVAPLLTQTAHHLDRGQYQSLILIAATSFGSFFCLLTGFFKTVWVFLFYILFIAGSIIVAEAVHTRNLGLMIRGLAAHDSGKHLVLRRRAAASQLSLYCTAIGGIGAALMAAFMYHMLRRTDQLTGLWVVSIFCGLIWFIGICHGLFTNRPSSSSPTTAFEPNFFTKLSYSMTLLRYPQAIGSLVAVFLSSFATMCIFTSGTLYAIGGVCIKPVLVLALWILYFLFPLISLPLLHPIQIIIRADAVRMQLLGFIICLFVSGAGFYFKSHRWRAAHIIVIALVQSTANGILYAFGRILLLDASPPGKEGAFSVWYAFVRVTGAMIGFAASSAGPGRAGGSFAAAFLGSFLGIIVLIFGNVSNIGALKAAGHLKGMDDEKRMGGLGMEKGEGMGSAVADSGESRGRV

SEQ ID NO: 1862 - protein, 624 aa, Zea mays
MASSLLSSPAKPTITTTTKTTPAPRPARSAHVHVLSAARCLRLRLRASSQHPPPPPTPRSRRPEYVPNRIDDPNYVRIFDTTLRDGEQSPGATMTSAQKLVVARQLARLGVDIIEAGFPASSPDDLDAVRSIAIEVGNPAPAGEDAAVHVPVICGLSRCNRRDIDAAWEAVRHARRPRIHTFIATSDIHMQHKLRKTPDQVVAIAREMVAYARSLGCTDVEFSPEDAGRSNREFLYHILGEVIKAGATTLNIPDTVGYNLPYEFGKLIADIKANTPGIEKAIISTHCQNDLGLATANTLAGARAGARQLEVTINGIGERAGNASLEEVVMAIKCRRELLDGLYTGIDSRHITLTSKMVQEHSGLHVQPHKAIVGANAFAHESGIHQDGMLKYKGTYEIISPDDIGLTRANEFGIVLGKLSGRHAVRSKLVELGYEIGDKEFEDFFKRYKEVAEKKKRVTDEDLEALLSDEIFQPKVIWSLADVQATCGTLALSTATVKLIAPDGEEKIACSVGTGPVDAAYKAVDKIIQIPTVLREYSMTSVTEGIDAIATTRVVVTGDVSNNAKHALTGQSFNRSFSGSGASMDIVVSSVRAYLSALNKICSFAGAVKASSDVAETASVPSTE

SEQ ID NO: 1863 - protein, 649 aa, Zea mays
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEEKQFAAEEISSMVLIKMREIAEAYLGSTIKNAVVTVPAYFNDSQRQATKDAGVIAGLNVLRIINEPTAAAIAYGLDKKATSVGEKNVLIFDLGGGTFDVSLLTIEEGIFEVKATAGDTHLGGEDFDNRMVNHFVQEFKRKNKKDITGNPRALRRLRTACERAKRTLSSTAQTTIEIDSLYEGIDFYSTITRARFEELNMDLFRKCMEPVEKCLRDAKMDKSTVHDVVLVGGSTRIPRVQQLLQDFFNGKELCKNINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQDAEKYKSEDEEHKKKVEAKNSLENYSYNMRNTIKDEKIASKLPADDKKKIEDAIDAAISWLDANQLAEADEFEDKMKELESLCNPIIAKMYQGAGEDMGGAGGMDEDAPAGSGGPGPKIEEVD

SEQ ID NO: 1864 - protein, 931 aa, Zea mays
MSKNLMQALLFFLLLLIKFFPSHTSVPHAMNAMQDLPSIAMSSNQNESGGGGGAGPPLPTAFKSPSTDGKSGSRRSTRFKDEDEYVEVTLDVRDGGGGGDDVAVLAIKDDVRDDTQDAASLLDRPAPGGAGGGLSSKLRAARARLGRIASGKRAAVPLSALLRRDPDRARLDRSVVTALRGLQFLNQAAVTEGWPEVEKRFHRLAVDGFLLRSRFGQCIGMVGSEEFAAQIFDALARRRGITAMVLTKDQVREFWEQLSDPGFDAKLQTFFDMVDKNADGQITEEELKEVLTLTASANKLSKILERVDEYTALIMEELDPDSLGYIEIANLESLLLQPPSQAPTRLVTHSSNISQLISQRLAPARDDGPLRRGARAVLYFAEDNWKRVWVMALWLAINAGLFTWKFLAYRRHPTFDVMGYCVCVAKGGAETTKFNMALILLPVCRNTITWLRSRTRLGAAVPFNDNINFHKVVAGGVAVGVALHAVTHLTCDFPRLLHASAAAYEPMKAYFGQRRIPNYWWFVRGVEGITGVIMVVLMAVAYTLAHPWFRRGKLSEGNPLRRLSGFNMFWYSHHLFVIVYVAFVVHGVCLYINRTWYKQTTWMYLAIPILLYAGERLLRALRSHGLTTVRIEKVALYPGNVIAIHMSKPHGFSYKSGQYIYVNCGEVSPFEWHPFTITSAPGDDYLSMHIRCRGDWTASFRALFAQVCRPPAAGQSGLLRADFASSTAAGGGGKLPKLLIDGPYGAPAQDYRKYDVLLLIGLGIGATPLISIVKDVLNNISDNKDEEQPAEFMTRRVYFYWCTREEGSFEWFRGVMNEVAERDARGDVVELHNHCTSVYEEGDARSALLVMLQALHHAKSGVDVVSGTRVRTHFARPNWRDVFKRVACNHQGQRVGVFYCGDQKVTPELRRLSQDFSHKTTTKFVFHKENF

SEQ ID NO: 1865 - protein, 1939 aa, Sus scrofa
MSSDQEMAIFGEAAPYLRKSEKERIEAQNKPFDAKTSVFVAEPKESFVKGTVQSREGGKVTVKTEAGATLTVKEDQVFPMNPPKFDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEPTSGKMQGTLEDQIISANPLLEAFGNAKTVRNDNSSRFGKFIRIHFGTTGKLASADIETYLLEKSRVTFQLKAERSYHIFYQIMSNKKPELIEMLLITTNPYDYAFVSQGEITVPSIDDQEELMATDSAIEILGFTSDERVSIYKLTGAVMHYGNLKFKQKQREEQAEPDGTEVADKAAYLQGLNSADLLKALCYPRVKVGNEFVTKGQTVQQVYNAVGALAKAVYDKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYEQHLGKSNNFQKPKPAKGKVEAHFSLIHYAGTVDYNITGWLDKNKDPLNETVVGLYQKSSVKTLAFLFTGAAGADAEAGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDIDHTQYKFGHTKVFFKAGLLGLLEEMRDEKLAQLITRTQARCRGFLARVEYQKMVERRESIFCIQYNIRAFMNVKHWPWMKLYFKIKPLLKSAETEKEMANMKEEFEKTKESLAKAEAKRKELEEKMVALMQEKNDLQLQVQAEADSLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKTKLEQQVDDLEGSLEQEKKLRMDLERAKRKLEGDLKLAQESTMDIENDKQQLDEKLKKKEFEMSNLQSKIEDEQALAMQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNMETVSKAKGNLEKMCRTLEDQLSELKTKEEEQQRLINDLTAQRARLQTESGEYSRQLDEKDTLVSQLSRGKQAFTQQIEELKRQLEEEIKAKSALAHAVQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMIDVERSNAACAALDKKQRNFDKILAEWKQKYEETHAELEASQKESRSLSTELFKVKNAYEESLDQLETLKRENKNLQQEISDLTEQIAEGGKRIHELEKIKKQVEQEKSEIQAALEEAEASLEHEEGKILRIQLELNQVKSEVDRKIAEKDEEIDQLKRNHVRVVESMQSMLDAEIRSRNDAIRLKKKMEGDLNEMEIQLNHANRMAAEALRNYRNTQGILKDTQIHLDDALRSQEDLKEQLAMVERRANLLQAEIEELRATLEQTERSRKVAEQELLDASERVQLLHTQNTSLINTKKKLETDISQIQGEMEDIIQEARNAEEKAKKAITDAAMMAEELKKEQDTSAHLERMKKNLEQTVKDLQHRLDEAEQLALKGGKKQIQKLEARVRELEGEVESEQKRNVETVKGLRKHERRVKELTYQTEEDRKNILRLQDLVDKLQAKVKSYKRQAEEAEEQSNVNLSKFRKLQHELEEAEERADIAESQVNKLRVKSREVHTKIISEE

SEQ ID NO: 1866 - protein, 1939 aa, Sus scrofa
MSSDQEMAIFGEAAPYLRKSEKERIEAQNRPFDAKTSVFVAEPKESFVKGTIQSREGGKVTVKTEAGATLTVKEDQVFPMNPPKFDKIEDMAMMTHLHEPGVLYNLKERYAAWMIYTYSGLFCVTVNPYKWLPVYNPEVVTAYRGKKRQEAPPHIFSISDNAYQFMLTDRENQSILITGESGAGKTVNTKRVIQYFATIAVTGEKKKEEPTSGKMQGTLEDQIISANPLLEAFGNAKTVRNDNSSRFGKFIRIHFGTTGKLASADIETYLLEKSRVTFQLKAERSYHIFYQITSNRKPELIEMLLITTNPYDYPFISQGEISVASIDDQEELIATDSAIDILGFTNEEKVSIYKLTGAVMHYGNLKFKQKQREEQAEPDGTEVADKAAYLQSLNSADLLKALCYPRVKVGNEYVTKGQTVEQVTNAVGALAKAVYEKMFLWMVTRINQQLDTKQPRQYFIGVLDIAGFEIFDFNSLEQLCINFTNEKLQQFFNHHMFVLEQEEYKREGIEWTFIDFGMDLAACIELIEKPMGIFSILEEECMFPKATDTSFKNKLYEQHLGKSANFQKPKPAKGKVEAHFSLIHYAGTVDYNITGWLDKNKDPLNDTVVGLYQKSALKTLAFLFSGAQTGEAEAGGTKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQYIDSKKASEKLLASIDIDHTQYKFGHTKVFFKAGLLGLLEEMRDDKLAQLITRTQARCRGFLARVEYQKMVERRESIFCIQYNIRAFMNVKHWPWMKLFFKIKPLLKSAETEKEMATMKEEFQKTKDELAKSEAKRKELEEKMVTLLKEKNDLQLQVQAEAEGLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKTKLEQQVDDLEGSLEQEKKLRMDLERAKRKLEGDLKLAQESIMDIENEKQQLDEKLKKKEFEISNLQSKIEDEQALAIQLQKKIKELQARIEELEEEIEAERASRAKAEKQRSDLSRELEEISERLEEAGGATSAQIEMNKKREAEFQKMRRDLEEATLQHEATAAALRKKHADSVAELGEQIDNLQRVKQKLEKEKSEMKMEIDDLASNMETVSKAKGNLEKMCRTLEDQLSELKSKEEEQQRLINDLTAQRGRLQTESGEFSRQLDEKEALVSQLSRGKQAYTQQIEELKRQLEEEIKAKNALAHALQSSRHDCDLLREQYEEEQESKAELQRALSKANTEVAQWRTKYETDAIQRTEELEEAKKKLAQRLQAAEEHVEAVNAKCASLEKTKQRLQNEVEDLMLDVERTNAACAALDKKQRNFDKILAEWKQKYEETHAELEASQKEARSLGTELFKMKNAYEESLDQLETLKRENKNLQQEISDLTEQIAEGGKRIHELEKIKKQVEQEKSEIQAALEEAEASLEHEEGKILRIQLELNQVKSEVDRKIAEKDEEIDQLKRNHVRVVESMQSMLDAEIRSRNDAIRLKKKMEGDLNEMEIQLNHANRMAAEALRNYRNTQGILKDTQIHLDDALRGQEDLKEQLAMVERRANLLQAEIEELRATLEQTERSRKVAEQELLDASERVQLLHTQNTSLINTKKKLETDISQMQGEMEDILQEARNAEEKAKKAITDAAMMAEELKKEQDTSAHLERMKKNMEQTVKDLQHRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLSKFRKLQHELEEAEERADIAESQVNKLRVKSREVHTKVISEE

SEQ ID NO: 1867 - protein, 1937 aa, Sus scrofa
MSSDQEMAIFGEAAPYLRKSEKERIEAQNKPFDAKTSVFVAEPKESFVKGTVQSREGGKVTVKTEAGATLTVKEDQVFPMNPPKFDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEPTPGKMQGTLEDQIISANPLLEAFGNAKTVRNDNSSRFGKFIRIHFGTTGKLASADIETYLLEKSRVTFQLKAERSYHIFYQIMSNKKPELIEMLLITTNPYDYAFVSQGEITVPSIDDQEELMATDSAIEILGFTSDERVSIYKLTGAVMHYGNLKFKQKQREEQAEPDGTEVADKAAYLQGLNSADLLKALCYPRVKVGNEFVTKGQTVQQVYNAVGALAKAVYDKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYEQHLGKSNNFQKPKPAKGKAEAHFSLIHYAGTVDYNITGWLDKNKDPLNETVVGLYQKSSVKTLAFLFAERQSSEEGGTKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDIDHTQYKFGHTKVFFKAGLLGTLEEMRDEKLAQLITRTQAMCRGFLMRVEFRKMMERRESIFCIQYNIRAFMNVKHWPWMKLYFKIKPLLKSAETEKEMANMKEEFEKTKEDLAKSEAKRKELEEKMVALMQEKNDLQLQVQAEADGLADAEERCDQLIKTKIQLEAKIKEVTERAEDEEEINAELTAKKRKLEDECSELKKDIDDLELTLAKVEKEKHATENKVKNLTEEMAGLDENIAKLTKEKKALQEAHQQTLDDLQAEEDKVNTLTKAKTKLEQQVDDLEGSLEQEKKLRMDLERAKRKLEGDLKLAQESTMDIENDKQQLDEKLKKKEFEMSNLQSKIEDEQALAMQLQKKIKELQARTEELEEEIEAERASRAKAEKQRSDLSRELEEISERLEEAGGATSAQIEMNKKREAEFQKMRRDLEEATLQHEATAAALRKKHADSVAELGEQIDNLQRVKQKLEKEKSELKMEIDDLASNMETVSKAKGNLEKMCRTLEDQLSEVKTKEEEHQRLINELSAQKARLQTESGEFSRQLDEKEALVSQLSRGKQAFTQQIEELKRQLEEETKAKSALAHAVQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMLDVERSNAACAALDKKQRNFDKILAEWKHKYEETQAELEASQKESRSLSTELFKVKNAYEESLDQLETLKRENKNLQQEISDLTEQIAEGGKHIHELEKVKKQIEQEKSELQAALEEAEASLEHEEGKILRIQLELNQVKSEIDRKIAEKDEEIDQMKRNHIRVVESMQSTLDAEIRSRNDALRIKKKMEGDLNEMEIQLNHANRQATEAIRNLRNTQGVLKDTQLHLDDAIRGQDDLKEQLAMVERRANLMQAEIEELRASLEQTERSRRVAEQELLDASERVQLLHTQNTSLINTKKKLETDISQIQGEMEDIVQEARNAEEKAKKAITDAAMMAEELKKEQDTSAHLERMKKNMEQTVKDLQHRLDEAEQLALKGGKKQIQKLEARVRELENEVENEQKRNVEAVKGLRKHERRVKELTYQTEEDRKNVLRLQDLVDKLQSKVKAYKRQAEEAEEQSNVNLSKFRKLQHELEEAEERADIAESQVNKLRVKSREVHTKVISEE

SEQ ID NO: 1868 - protein, 1935 aa, Sus scrofa
MVDAEMAAFGEAAPYLRKSEKERLEAQTRPFDLKKDVYVPDDKEEFVKAKILSREGGKVTAETEHGKTVTVKEDQVLQQNPPKFDKIEDMAMLTFLHEPAVLYNLKERYASWMIYTYSGLFCVTINPYKWLPVYNAEVVAAYRGKKRSEAPPHIFSISDNAYQYMLTDRENQSILITGESGAGKTVNTKRVIQYFAVIAAIGDRSKKEQTPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVMYATGALAKAVYEKMFNWMVTRINTTLETKQPRQYFIGVLDIAGFEIFDFNSFEQLCINFTNEKLQQFFNHHMFVLEQEEYKKEGIEWEFIDFGMDLQACIDLIEKPMGIMSILEEECMFPKATDMTFKAKLYDNHLGKSNNFQKPRNIKGRPEAHFALIHYAGTVDYNIIGWLQKNKDPLNETVVDLYKKSSLKLLSNLFANYAGADTPVEKGKGKAKKGSSFQTVSALHRENLNKLMTNLRSTHPHFVRCIIPNETKSPGVIDNPLVMHQLRCNGVLEGIRICRKGFPNRILYGDFRQRYRILNPAAIPEGQFIDSRKGAEKLLGSLDIDHNQYKFGHTKVFFKAGLLGLLEEMRDERLSRIITRIQAQSRGVLSRMEFKKLLERRDSLLIIQWNIRAFMSVKNWPWMKLYFKIKPLLKSAETEKEMATMKEEFGRLKEALEKSEARRKELEEKMVSLLQEKNDLQLQVQAEQDNLADAEERCDQLIKNKIQLEAKVKEMTERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQHVDDLEGSLEQEKKVRMDLERAKRKLEGDLKLTQESIMDLENDKQQLDERLKKKDFELNALNARIEDEQALGSQLQKKLKELQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKLELQSALEEAEASLEHEEGKILRAQLEFNQIKAEMERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMEADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 1869 - protein, 377 aa, Sus scrofa; identical to SEQ ID NO: 898

SEQ ID NO: 1870 - protein, 1992 aa, Sus scrofa
  MOD_RES (653)..(653): Any amino acid
  MOD_RES (1020)..(1020): Any amino acid
MTTQAPTFTQPLQSVVVLEGSTATFEAHVSAKCCVHLSLCSCMGKIIVQLTFLRAELSFRDGLARLTIPAVTKANSGRYSLRATNGSGQATSTAELLVTAETAPPNFVQRLQSMTVRQGSQVRLQVRVTGIPGAEIQSSVDFQISQEGDLYSLLIAEAYPEDSGTYSVNATNSVGRATSTAELLVQGEEVVPAKKTKTIVSTAQISETRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAGRISTSPIRSVKSPLLIRKTPTMPPGPEVPPPWKQEGYMASTEAEMRETTVTSATQIRTEERWEGRYGIQEQVTISGAAGAAASVSASAAFAAGAVATGAAEVKQETDKSAAVATVVAAVDMARVREPVISAVEQTAQRTTTTAVHIQPAQEQIRKEAEKTAVTKVVVAADKAKEQELKSRTREVITTKQEQVHVTHEQIRKETEKAFVPKVVISTTKAKEQETRITGEITTKEEQKQITQEKIMKETRKTVVPKVIVATPKVKEQDLVSRTREGITTQREQVQITQEKMRKEAEKTALSTIAVATAKAKEQETILRTREEMATRQEQIQVIHGKVGVGKKAEAVATVVAXDQARVREPREPGHVEESHAQQTTLEYGYKEHVSAAKVTEHVSAAKVAEHPPRPASEPHVVPKAVKPRVIQAPSETHITTTDQMGMHISTQIKKTTDLTSERLVHVDKRPRTASPHFTVSKISVPKAEHGYEASIAGSAIATLQKELSATPSAQKVTKSVKAPTVKPAEARVRAEPTPSPQFPFADTAETFKSQAGIEVKKEVGVSITAAAVREERFEVLREREAKVTETARVPAPVEIPVTPPTLVSGLKNVTVIEGESVTLECHISGYPSPKVTWYREDYQIESSIDFQITFQSGIARLMIREAFAEDSGRFTCSAVNEAGTVSTSCYLAVQVSEEFEKETTAVAEKITTEEKRFDFFNPFSIVVXDTSIAEEPAAPGEPAAPFFITKPVVQKLVEGGSIVFECQVGGNPKPHVYWKKSGVPLTSGYRYKVSYNKQTGECKLVISMTFADDAGEYTIVIRNKHGETSASASLLEESDYESLMRSQQEMLYQTQMTAFVQEPKVGEIAPGYVYSEYEKEYEKEQALIRKKMAKDTVMVRTFVEDQEFHISSFEERLIKEIEYRIIKTTLEELLEEDGEEKMAVDISESEAIEAGFDLRVKNYRILEGMGVTFHCKMSGYPLPKIAWYKDGKRIRHGERYHMDFLQDGRASLRIPVVLPEDEGIYTAFASNIKGNAICSGKLYVEPAAPLSAPTYIPTPEPVSRIRSISPRSVSRSPIRISPARMSPARMSPARLSPGRRLEKPVFVLKPTSFKCLEGQTARFDLKVVGRPMPETFWFHNGQQIVNDYTHKVVIKEDGTQSLIIVPASPSDSGEWTVVAQNRAGKSSISVILTVEAVEHQVKPVFVEKLKNVNVKEGSRLEMKVRATGNPNPDIVWLKNSEIIVPHKYPKIRIEGTKGEAALKIDSTVSQDSAWYTATAINKAGRDTTRCKVNVEVEFAEPEPERRLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGVITCRATNKYGTDHTSATLIVKDEKSLVEESQLPEGRKGLQRIEELERMAHEGALTGVTTDQKEKQKPDIVLFPEPVRVLEGETARFRCRVTGYPQPKVNWYLNGQLIRKSKRFRVRYDGIHYLDIVDCKSYDTGEVKVTAENPEGVTEHKVKLEIQQREDFRSVLRRAPEPKPEFHIHEPGKLQFEVQKVDRPVDTTETKEIVRLKRAERITHEKVPEESEELRSKFKRRTEEGYYEAITAVELKSRKKDESYEELLRKTKEELLHWTKELTEEEKKAL

SEQ ID NO: 1871 - protein, 842 aa, Sus scrofa
MSRPLTDQEKRKQISVRGLAGVENVAELKKNFNRHLHFTLVKDRNVANARDYYFALAYTVRDHLVGRWIRTQQHYYEKDPKRIYYLSLEFYMGRTLQNTMVNLALENACDEATYQLGLDMEELEEMEEDAGLGNGGLGRLAACFLDSMATLGLAAYGYGIRYEFGIFNQKITGGWQMEEADDWLRYGNAWEKARPEFTLPVHFYGRVEHTNQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCRDPVRTSFDAFPDKVAIQLNDTHPSLAIPELMRILVDEERLEWEKAWDVTVRTCAYTNHTVLPEALERWPVHLMETLLPRHLQIIYEINQRFLNRVAAAYPGDVDRLRRMSLVEEGAVKRINMAHLCIAGSHAVNGVARIHSEILKKTIFKDFYELEPHKFQNKTNGITPRRWLVMCNPGLAEVIAERIGEEYIADLDQLRKLLSYVDDEAFIRDVAKVKQENKLKFSAYLEREYKVHINPNSLFDIQVKRIHEYKRQLLNCLHVITLYNRIKKEPNKFVVPRTVMIGGKAAPGYHMAKMIIKLITAIGDVVNHDPVVGDRLRVIFLENYRVSLAEKVIPAADLSEQISTAGTEASGTGNMKFMLNGALTIGTMDGANVEMAEEAGEENFFIFGMRVEDVERLDQKGYNAQEYYDRIPELRHVIDQLSSGFFSPKQPDLFKDIVNMLMHHDRFKVFADYEDYIKCQERVSALYKNPREWTRMVIRNIATSGKFSSDRTIAQYAREIWGVEPSRQRLPAPDEKI

SEQ ID NO: 1872 - protein, 894 aa, Sus scrofa
MNQVEPGVQYNYVYEDDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDIVNTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERVEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERTEKLLETIDQLHLEFAKRAAPFNNWMEGAMEDLQDMFIVHSIEEIQSLITAHEQFKATLPEADGERQSILAIQNEVEKVIQSYNIRISSSNPYSTVTVDDIRAKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYTAFSSALYGESDL

SEQ ID NO: 1873 - protein, 381 aa, Sus scrofa
MPFGNTHNKYKLNFKAEEEYPDLSKHNNHMAKALTLEIYKKLRDKETPSGFTLDDVIQTGVDNPGHPFIMTVGCVAGDEESYVVFKDLFDPIIQDRHGGYKPTDKHKTDLNHENLKGGDDLDPNYVLSSRVRTGRSIKGYTLPPHCSRGERRAVEKLSVEALNSLTGEFKGKYYPLKSMTEQEQQQLIDDHFLFDKPVSPLLLASGMARDWPDARGIWHNDNKSFLVWVNEEDHLRVISMEKGGNMKEVFRRFCVGLQKIEEIFKKAGHPFMWNEHLGYVLTCPSNLGTGLRGGVHVKLAHLSKHPKFEEILTRLRLQKRGTGGVDTAAVGSVFDVSNADRLGSSEVEQVQLVVDGVKLMVEMEKKLEKGQSIDDMIPAQK

SEQ ID NO: 1874 - protein, 607 aa, Sus scrofa
MKWVTFISLLFLFSSAYSRGVFRRDTYKSEIAHRFKDLGEQYFKGLVLIAFSQHLQQCPYEEHVKLVREVTEFAKTCVADESAENCDKSIHTLFGDKLCAIPSLREHYGDLADCCEKEEPERNECFLQHKNDNPDIPKLKPDPVALCADFQEDEQKFWGKYLYEIARRHPYFYAPELLYYAIIYKDVFSECCQAADKAACLLPKIEHLREKVLTSAAKQRLKCASIQKFGERAFKAWSLARLSQRFPKADFTEISKIVTDLAKVHKECCHGDLLECADDRADLAKYICENQDTISTKLKECCDKPLLEKSHCIAEAKRDELPADLNPLEHDFVEDKEVCKNYKEAKDVFLGTFLYEYSRRHPDYSVSLLLRIAKIYEATLEDCCAKEDPPACYATVFDKFQPLVDEPKNLIKQNCELFEKLGEYGFQNALIVRYTKKVPQVSTPTLVEVARKLGLVGSRCCKRPEEERLSCAEDYLSLVLNRLCVLHEKTPVSEKVTKCCTESLVNRRPCFSALTPDETYKPKEFVEGTFTFHADLCTLPEDEKQIKKQTALVELLKHKPHATEEQLRTVLGNFAAFVQKCCAAPDHEACFAVEGPKFVIEIRGILA

SEQ ID NO: 1875 - protein, 434 aa, Sus scrofa
MAMQKIFAREILDSRGNPTVEVDLHTAKGRFRAAVPSGASTGIYEALELRDGDKSRYLGKGVLKAVEHINKTLGPALLEKKLSVVDQEKVDKFMIELDGTENKSKFGANAILGVSLAVCKAGAAEKGVPLYRHIADLAGNPDLVLPVPAFNVINGGSHAGNKLAMQEFMILPVGASSFREAMRIGAEVYHHLKGVIKGKYGKDATNVGDEGGFAPNILENNEALELLKTAIQAAGYPDKVVIGMDVAASEFYRNGKYDLDFKSPDDPSRHITGEKLGELYKSFIKNYPVVSIEDPFDQDDWKTWTSFLSGVNIQIVGDDLTVTNLKRIAQAVEKKACNCLLLKVNQIGSVTESIQACKLAQSNGWGVMVSHRSGETEDTFIADLVVGLCTGQIKTGAPCRSERLAKYNQLMRIEEALGDKAVFAGRKFRNPKAK

SEQ ID NO: 1876 - protein, 993 aa, Sus scrofa
MEAAHSKTTEECLAYFGVSETTGLTPDQVKRHLEKYGHNELPAEEGKSLWELVIEQFEDLLVRILLLAACISFVLAWFEEGEETVTAFVEPFVILLILIANAIVGVWQERNAENAIEALKEYEPEMGKVYRADRKAVQRIKARDIVPGDIVEVAVGDKVPADIRILTIKSTTLRVDQSILTGESVSVIKHTEPVPDPRAVNQDKKNMLFSGTNIAAGKAIGIVATTGVNTEIGKIRDQMAATEQDKTPLQQKLDEFGEQLSKVISLICVAVWLINIGHFNDPVHGGSWIRGAIYYFKIAVALAVAAIPEGLPAVITTCLALGTRRMAKKNAIVRSLPSVETLGCTSVICSDKTGTLTTNQMSVCKMFVIDKVEGDICLLNEFSITGSTYAPEGEVLKNDKPVRAGQYDGLVELATICALCNDSSLDFNEAKGVYEKVGEATETALTTLVEKMNVFNTDVRNLSKVERANACNSVIRQLMKKEFTLEFSRDRKSMSVYCSPAKSRAAVGNKMFVKGAPEGVIERCNYVRVGTTRVPMTGPVKERILSVIKEWGTGRDTLRCLALATRDTPPKREDMVLDDSARFMEYETDLTFVGVVGMLDPPRKEVTGSIQLCRDAGIRVIMITGDNKGTAIAICRRIGIFGENEDVADRAYTGREFDDLPLPEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRSPKEPLISGWLFFRYMAIGGYVGAATVGAAAWWFLYADDGPHVTYSQLTHFMKCGEHNPDFEGVDCEVFEAPQPMTMALSVLVTIEMCNALNSLSENQSLMRMPPWVNIWLVGSIGLSMSLHFLILYVDPLPMIFKLQALDLAHWLMVLKISLPVIGLDEILKFVARNYLEG

SEQ ID NO: 1877 - protein, 540 aa, Sus scrofa
SSGPKTSEAMPKPHSDAGTAFIQTQQLHAAMADTFLEHMCRLDIDSPPITARNTGIICTIGPASRSVETLKEMIKSGMNVARLNFSHGTHEYHAETIKNVRAATESFASDPILYRPVAVALDTKGPEIRTGLIKGSGTAEVELKKGATLKITLDNAYMEKCDENVLWLDYKNICKVVDVGSKVYVDDGLISLLVKQKGPDFLVTEVENGGFLGSKKGVNLPGAAVDLPAVSEKDIQDLKFGVEQDVDMVFASFIRKAADVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEAAAVGAVEASFKCCSGAIIVLTKSGRSAHQVARYRPRAPIIAVTRNHQTARQAHLYRGIFPVVCKDPVQEAWAEDVDLRVNLAMNVGKARGFFKKGDVVIVLTGWRPGSGFTNTMRVVPVP

SEQ ID NO: 1878 - protein, 903 aa, Sus scrofa
MMMVMQPEGLGTREGPFAGGSGGGGEYMEQEEDWDRDLLLDPAWEKQQRKTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRVQEKCQLEINFNTLQTKLRLSHRPAFMPSEGKLVSDIANAWRGLEQVEKGYEDWLLSEIRRLQRLQHLAEKFQQKASLHEAWTRAGKEDMLSQRDYESASLQEVRALLRRHEAFESDLAAHQDRVEHIAALAQELNELDYHEAASVNSRCQAICDQWDNLGTLTQKRRDALERMEKLLETIDQLQLEFARRAAPFNNWLDGAVEDLQDVWLVHSVEETQSLVTAHEQFKATLPEADRERGAILGIQGEIQKICQTYGLRPSSTNPYIALSPQDINTKWDTVRKLVPSRDQMLQEELTRQQVNERLRRQFAAQANAIGPWIQGKVEEVGRLAAGMAGSLEEQMAGLRQQEQNIINYKSNIDRLEGDHQLLQESLVFDNKHTVYSMEHIRVGWEQLLTSIARTINEVENQVLTRDAKGLSQEQLNEFRASFNHFDRKRNGMMEPDDFRACLISMGYDLGEVEFARIMTMVDPNAAGVVTFQAFIDFMTRETAETDTAEQVVASFKILAGDKNYITAEELRRELPAEQAEYCIRRMAPYKGAGAPAGALDYVAFSSALYGESDL

SEQ ID NO: 1879 - protein, 333 aa, Sus scrofa
MVKVGVNGFGRIGRLVTRAAFNSGKVDIVAINDPFIDLHYMVYMFQYDSTHGKFHGTVKAENGKLVINGKAITIFQERDPANIKWGDAGATYVVESTGVFTTMEKAGAHLKGGAKRVIISAPSADAPMFVMGVNHEKYDNSLKIVSNASCTTNCLAPLAKVIHDHFGIVEGLMTTVHAITATQKTVDGPSGKLWRDGRGAAQNIIPASTGAAKAVGKVIPELNGKLTGMAFRVPTPNVSVVDLTCRLEKPAKYDDIKKVVKQASEGPLKGILGYTEDQVVSCDFNSDTHSSTFDAGAGIALNDHFVKLISWYDNEFGYSNRVVDLMVHMASKE

SEQ ID NO: 1880 - protein, 1042 aa, Sus scrofa
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDKVEGDTCSLNEFTITGSTYAPIGEVHKDDKPVKCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTPGVKQKIMSVIREWGSGSDTLRCLALATHDNPMRREEMNLEDSANFIKYETNLTFVGCVGMLDPPRIEVASSVKLCRQAGIRVIMITGDNKGTAVAICRRIGIFGQDEDVTSKAFTGREFDELNPSAQREACLNARCFARVEPSHKSKIVEFLQSFDEITAMTGDGVNDAPALKKSEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVTFYQLSHFLQCKEDNPDFEGVDCAVFESPYPMTMALSVLVTIEMCNALNSLSENQSLLRMPPWENIWLVGSICLSMSLHFLILYVEPLPLIFQITPLNLTQWLMVLKISLPVILMDETLKFVARNYLEPGKECVQPATKSCSFSACTDGISWPFVLLIMPLVIWVYSTDTNFSDMFWS

SEQ ID NO: 1881 - protein, 1137 aa, Sus scrofa
DEEEASPPSALPPGLSSRALERKDSEWSVGEPPAGEEQDKQNANSQLSTLFVEKPQSGEVKVGENITFIAKVKAEDLLRKPTIKWFKGKWMDLASKAGKHLQLKETFERHSRVYTFEMQIIKAKENYAGNYRCEVTYKDKFDSCSFDLEVHESTGTTPNIDIRSAFKRSGDGQDDAGELDFSGLLKRREVKQQEEEPEVDVWELLKNANPNEYERIAFQYGITDLRGMLKRLKRMRRVEKKSAAFSKILDPAYQVDKGGRVRFAVELADPKLEVKWYKNGQEIRPSTKYIFEHKGCERIMFINNCGLTDDSEYYVTAGDEKCSTELFVREPPVMVTKQLEDTKAYCGERVELECEVSEDDANVKWFKNGEEIIPGPKSRYRIKVDGKKHILIIEGATKADTAEYSVMTTGGQSSAKLSVDLKPLKILTPLTDQTVNLGKEICLKCEISENISGKWTKNSLPVQETDRLKIIHKGRIHKLVIANALTEDEGDYVFAPDAYSVTLPAKVHVIDPPRINLDGLGPDNTVTVIAGNKLRLEIPISGEPPPKVIWSRADKAIMEGSGRIRAESYPDSSTLVIDVAERDDSGVYNISLKNEAGEAHASIKVKVVDIPDPPVAPNVKEVGDDWCIMTWDPPLYDGGSPILGYFIERKKKQSSRWMRLNFDLCKETTFEPKKMIEGVAYEVRIFAVNAVGISKPSMPSRPFVPLAVTSPPTLLAVDSVTDTTVTMKWRPPDQIGAAGLDGYVLEYCYEGSDNWLPAHKDLIDKTKFTITDLPTDAKIFVRVKAVNAAGASEPKYYSQPILVKQIIEPPKIRIPRHLKQTYIRRVGEAINLVIPFQGKPKPELTWKKDGKEIDKNQINIRNSETDSIIFIRKAERSHSGKYDLEVKVEKFMETASIDIQVVDRPGPPQVVKIDDVWGENVALSWTPPKDDGNAAITGYTIQKADKKSMEWFTVIEHYHRTSATISELVIGNEYYFRVFSENMCGLSEDATMTKESAVIAKDGKIYKNPVYEDFDFTEAPMFTQPLVNTYAVAGYNATLNCSVRGNPKPKITWMKNKVTIKDDPRYRMFSNQGVCTLEIRKPSPYDGGTYCCKAVNDLGTVEIECKLEVKVIYQGVNTPGQPVFLEGQQQVLKVPIP

SEQ ID NO: 1882 - protein, 1366 aa, Sus scrofa
MLSFVDTRTLLLLAVTSCLATCQSLQEATARKGPTGDRGPRGERGPPGPPGRDGDDGIPGPPGPPGPPGPPGLGGNFAAQYDGKGVGAGPGPMGLMGPRGPPGAVGAPGPQGFQGPAGEPGEPGQTGPAGARGPPGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGNDGSVGPVGPAGPIGSAGPPGFPGAPGPKGELGPVGNPGPAGPAGPRGEVGLPGVSGPVGPPGNPGANGLPGAKGAAGLPGVAGAPGLPGPRGIPGPAGAAGATGARGLVGEPGPAGSKGESGNKGEPGAAGPQGPPGPSGEEGKRGPNGEVGSAGPPGPPGLRGNPGSRGLPGADGRAGVMGPPGSRGPTGPAGVRGPNGDSGRPGEPGLMGPRGFPGSPGNVGPAGKEGPAGLPGIDGRPGPIGPAGARGEPGNIGFPGPKGPTGDPGKNGEKGHAGLAGARGAPGPDGNNGAQGPPGPQGVQGGKGEQGPAGPPGFQGLPGPAGTAGEVGKPGERGIPGEFGLPGPAGPRGERGPPGESGAAGPAGPIGSRGPSGPPGPDGNKGEPGVLGAPGTAGPSGPSGLPGERGAAGIPGGKGEKGETGLRGDVGSPGRDGARGAPGAVGAPGPAGANGDRGEAGPAGPAGPAGPRGSPGERGEVGPAGPNGFAGPAGAAGQPGAKGERGTKGPKGENGPVGPTGPVGAAGPAGPNGPPGPAGSRGDGGPPGATGFPGAAGRIGPPGPSGISGPPGPPGPAGKEGLRGPRGDQGPVGRTGETGASGPPGFAGEKGPSGEPGTAGPPGTPGPQGILGAPGFLGLPGSRGERGLPGVAGSVGEPGPLGIAGPPGARGPPGAVGNPGVNGAPGEAGRDGNPGSDGPPGRDGQAGHKGERGYPGNPGPAGAAGAPGPQGAVGPAGKHGNRGEPGPAGSVGPAGAVGPRGPSGPQGIRGEKGEPGDKGPRGLPGLKGHNGLQGLPGLAGHHGDQGAPGPVGPAGPRGPAGPSGPAGKDGRTGQPGAVGPAGIRGSQGSQGPAGPPGPPGPPGPPGPSGGGYDFGYEGDFYRADQPRSPPSLRPKDYEVDATLKSLNNQIETLLTPEGSRKNPARTCRDLRLSHPEWSSGYYWIDPNQGCTMDAIKVYCDFSTGETCIRAQPENIPAKNWYRNSKVKKHVWLGETINGGTQFEYNMEGVTTKEMATQLAFMRLLANHASQNITYHCKNSIAYMDEETGNLKKAVILQGSNDVELVAEGNSRFTYTVLVDGCSKKTNEWRKTIIEYKTNKPSRLPILDIAPLDIGDADQEVSVDVGPVCFK

SEQ ID NO: 1883 - protein, 2038 aa, Sus scrofa
DYENKIKGKWSETPCFEIATARMNAKNISTRKYQEDFENMKDQIYFMQTETPEYKVNKQAGTAASKVKYKEDYEKNKGKADYNVLPASENPLLRHLKAAGDALSDKRYKENYEKTKAKSINYCETPKFKLDTVLHNFSSDTKYKDSYLKNILGHYVGSFEDPYHTHCMKVAAENSDKNYKAEYEEDRGKGFFPQTITQEYEAIKKLDQCKDHTYKVHPDKTKFTQVTDSPVLVQAQVNSKQLSDLNYKAKHENEKFKCHIPPDTPAFIQHKVNAYNLSDNVYKHDWEKTKAKKFDIKVDAIPLLAAKANTKNTSDVMYKKDYEKSKGKMIGALSINDDPKMLHSLKTAKNQSDRLYKENYEKTKAKSMNYCETPKYQLDTLLKNFSEAKYKDSYVQNVLGHYIGSFEDPYQLHCMKVSAQNSDKNYKAEYEEDKGKCYFPQTITQEYEAIKKLDQCKDHTYKVHPDKTKFTAVTDTPVLLQAQLNTKQLSDLNYKAKHEGEKFKCNIPADAPQFIQHRVNAYNLSDNVYKHDWEKTKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHLLHNYSYPPDSINVDLAKKAYALQSDLDFFFSADQNLCIKKFFWVVVFRSLKLKEGCNYKHKSEFMKQKKYRQHPETLKFTSIEDAPIIVQSKINQAQRSDIAYKAKGEEIIHKYSLPADLPQFIQAKVNAYNISESMYKADLKDLSKKGYDLRTDAIPIKAAKAARQAASDVQYKKDYEKAKGKMVGFQSLQDDPKLVHYMNVAKIQSDREYKKDYEKTKTKYNTPHDMFNVVAAKKAQDVASNVNYRHSLHHYTYLPDAMDLELSKNMMHIQSDNAYKEDYNTWMKGIGWIPLGSLEVEKVKKAGDALNEKKYRQHPDTLKFTSIVDSPVMVQAKQNTRQVSDILYKAKGEDVKHKYTMGPDLPQFLQAKCNAYNISDVCYKRDWHDLIAKGNNVLGDAIPITAAKASRNIASDYKYKEAYEKAKGKHVGFRSLQDDPKLVHYMNVAKLQSDREYKKNYENTKTSYHTPGDMVSITAAKMAQDVATNVNYKQPIHHYTYLPDALSLEHTRNVNQIQSDNVYKDEYNHFFKGIGWIPLGSLEVEKVKKAGDALNERKYRQHPDTIKFTSVPDSMGMVLAQHNTKQLSDLNYKVEGEKLKHKYTMDPDVPQFIQAKVNAINMSDAHYKADWKKTLANGYDLTPDAIPIVAAKSSRNIASDFKYKEAYEKAKGKQVGFRSLQDDPKLVHYMNVAKIQSDREYKKGYEASKTRYHTPLDMLSVTAAKKSQEVATNTNYKQPFHHYTLLPDALNVEHSRNAMQIQSDNLYKSDFTNWMKGIGWIPMESLEVEKAKKAGEILSEKKYRQHPEKLKFTYAMDTMEQALNKSNKLIMDKRLYTEKWNKDKTTIHVMPDTPDILLSRVNQITLSDKLYKAGWEEEKKKGYDLRPDAISIKAARASRDIASDYKYKQAYEQAKGKHIGFRSLEDDPKLVHFMQVAKMQSDREYKKAYEKSKTSFHTPVDMLSVVAAKKSQEVATNANYRNVIHTYNMLPDAMSFELAKNMMQLQSDNQYKADYADFMKGIGWLPLGSLEAEKNKKAMEIISEKKYRQHPDTLKYSTLMDSMNMVLAKNNAKIMNEHLYKQAWEADKTKVHIMPDIPQIILAKANAVNMSDKLYKLSLEESKKKGYDLRTDAISIQAAKASRDIASDYKYKHSYEKERGKMVGFRSLEDDPKLVHSMQVAKMQSDREYKKSYEKTKTSYHTPADMLSVTAARDAQANITNTNYKHLIHKYILLPDAMNIQLSKNMNHIQSDNEYKQDYNECYKGLGWSPAGSLEVEKAKKATEYASDQKYRQHPSNFQFQKLNDSMDMVLAKQNAHTMNKYLYTADWNKDKTKIHVMPDTPDILQAKQNQTLFSQKLYKLGWEEALKKGYDLPVDAISVQLAKVSRDNASDIKYQKG

SEQ ID NO: 1884 - protein, 296 aa, Sus scrofa
MASHRHAGPSSYKVGTMAEKFDCHYCRDPLQGKKYVQKDGHHCCLKCFDKFCANTCVECRKPIGADSKEVHYKNRYWHDTCFRCSKCLHPLANETFMAKDNKILCNKCTTREDSPKCKGCFKPIVAGDQNVEYKGTVWHKDCFTCSNCKQVIGTGSFFPKGEDFYCVTCHETKFAKHCVKCNKAITSGGITYQDQPWHAECFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 1885 - protein, 192 aa, Sus scrofa
MAPKKDVKKPAAAAAPAPAPAPAPAPAPAPPKEEKIDLSAIKIEFSKEQQDEFKEAFLLFDRTGECKITLSQVGDVLRALGTNPTNAEVKKVLGNPSNEEMNAKKIEFEQFLPMLQAISNNKDQGSYEDFVEGLRVFDKEGNGTVMGAELRHVLATLGEKMKEEEVEALMAGQEDSNGCINYEAFVKHIMSI

SEQ ID NO: 1886 - protein, 248 aa, Sus scrofa
MAPARKFFVGGNWKMNGRKNNLGELINTLNAAKLPADTEVVCAPPTAYIDFARQKLDPKIAVAAQNCYKVANGAFTGEISPGMIKDLGATWVVLGHSERRHVFGESDELIGQKVAHALAEGLGVIACIGEKLDEREAGITEKVVFEQTKVIADNVKDWNKVVLAYEPVWAIGTGKTATPQQAQEVHEKLRGWLKTHVSEAVAQSTRIIYGGSVTGATCKELASQPDVDGFLVGGASLKPEFVDIINAK

SEQ ID NO: 1887 - protein, 5035 aa, Sus scrofa
MGDGGEGEDEVQFLRTDDEVVLQCNATVLKEQLKLCLAAEGFGNRLCFLEPTSNAQNVPPDLAICCFVLEQSLSVRALQEMLANTVEAGVESSQGGGHRTLLYGHAILLRHAHSGMYLSCLTTSRSMTDKLAFDVGLQEDATGEACWWTTHPASKQRSEGEKVRVGDDLILVSVSSERYLHLSTASGELQVDASFMQTLWNMNPICSGCEEGYVTGGHVLRLFHGHMDECLTISPADSDDQRRLVYYEGGSVCTHARSLWRLEPLRISWSGSHLRWGQPLRIRHVTTGRYLALIEDQGLVVVDASKAHTKATSFCFRISKEKLDTAPKRDVEGMGPPEIKYGESLCFVQHVASGLWLTYAAPDPKALRLGVLKKKAILHQEGHMDDALSLTRCQQEESQAARMIYSTAGLYNHFIKGLDSFSGKPRGSGAPAGTALPLEGVILSLQDLIGYFEPPSEELQHEEKQSKLRSLRNRQSLFQEEGMLSLVLNCIDRLNVYTTAAHFAEFAGEEAAESWKEIVNLLYEILASLIRGNRANCALFSNNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVVPFLTAQATHLRVGWALTEGYSPYPGGGEGWGGNGVGDDLYSYGFDGLHLWTGHVPRLVTSPGQHLLAPEDVVSCCLDLSVPSISFRINGCPVQGVFEAFNLNGLFFPVVSFSAGVKVRFLLGGRHGEFKFLPPPGYAPCHEAVLPRERLRLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLRKTKLPKTYMMSNGYKPAPLDLSHVRLTPAQTTLVDRLAENGHNVWARDRVAQGWSYSAVQDIPARRNPRLVPYRLLDEATKRSNRDSLCQAVRTLLGYGYNIEPPDQEPSQVESQSRWDRVRIFRAEKSYAVQSGRWYFEFEAVTTGEMRVGWARPELRPDVELGADELAYVFNGHRGQRWHLGSELFGRPWQSGDVVGCMIDLTENTIIFTLNGEVLMSDSGSETAFRDIEVGDGFLPVCSLGPGQVGHLNLGQDVSSLRFFAICGLQEGFEPFAINMQRPVTTWFSKSLPQFEAVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGRWGEAEGGKEGTAKEGAPGGTAQAGVEAQPPRAENEKDATTEKNKKRGFLFKAKKAAMMTQPPATPTLPRLPHEVVPADDRDDPDIILNTTTYYYSVRVFAGQEPSCVWVGWVTPDYHQHDMNFDLTKVRAVTVTMGDEQGNIHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFLSERKNPAPQCPPRLEMQMLMPVSWSRMPNHFLRVETRRAGERLGWAVQCQEPLTMMALHIPEENRCMDILELSERLDLQQFHSHTLRLYRAVCALGNNRVAHALCSHVDQAQLLHALEDAHLPGPLRAGYYDLLISIHLESACRSRRSMLSEYIVPLTPETRAITLFPPGKRTENGPRRHGLPGVGVTTSLRPPHHFSAPCFVAALPAVGAAEAPARLSPSIPLEALRDKALRMLGEAVRDGGQHARDPVGGSVEFQFVPVLKLVSTLLVMGIFGDEDVKQILKMIEPEVFTEEEEEEEEEEEEEEEDEEEKEEDEEEEAREKEDEEKEEEETAEGEKEEYLEEGLLQMKLPESVKLQMCNLLEYFCDQELQHRVESLAAFAERYVDKLQANQRDRYGILMKAFTMTAAETARRTREFRSPPQEQINMLLHFKDGEDEEDCPLPDEIRQDLLEFHQDLLTHCGIQLEGEEEEPEEEATLGSRLMSLLEKVRLVKKKEEKSEEEPPAEESKAQSLQELVSHTVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLLAKGYPDIGWNPCGGERYLDFLRFAVFVNGESVEENANVVVRLLIRKPECFGPALRGEGGSGLLATIEEAIRISEDPARDGPGVRRDRRREHFGEEPPEENRVHLGHAIMSFYAALIDLLGRCAPEMHLIQAGKGEALRIRAILRSLVPLDDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEECLMALCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDAREGYNPQPPDLSGVTLSRELQAMAEQLAENYHNTWGRKKKQELEAKGGGTHPLLVPYDTLTAKEKARDREKAQELLKFLQMNGYAVTRGLKDMELDTSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTRNPYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPPALPAGAPPPCTAVTSDHLNSLLGNILRIIVNNLGIDEASWMKRLAVFAQPIVSRARPELLHSHFIPTIGRLRKRAGKVVAEEEQLRLEAKAEAEEGELLVRDEFSVLCRDLYALYPLLIRYVDNNRAHWLTEPNPSAEELFRMVGEIFIYWSKSHNFKREEQNFVVQNEINNMSFLTADNKSKMAKSGGSDQERTKKKRLGDRYSVQTSLIVATLKKMLPIGLNMCAPTDQELITLAKTRYALKDTDEEVREFLQNNLHLQGKVEGSPSLRWQMALYRGLPGREEDADDPEKIVRRVQEVSAVLYHLEQMEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAQEEVEVSFEEKEMEKQRLLYQQARLHNRGAAEMVLQMISACKGETGAMVSSTLKLGISILNGGNADVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFTGPEIQFLLSCSEADENEMIDCEEFANRFQEPARDIGFNVAVLLTNLSEHVPHDPRLRNFLELAESILEYFRPYLGRIEIMGASRRIERIYFEISETNRAQWEMPQVKESKRQFIFDVVNEGGESEKMELFVSFCEDTIFEMQIAAQISEPEGEPEEDEDEGAGLAEAGAEGAEEGAVGPEGAAGTAAAGLTARLAAATSRALRGLSYRSLRRRVRRLRRLTAREAATALAALLWAALAHAGAAGAGAAAGALRLLWGSLFGGGLVEGAKKVTVTELLAGMPDPTGDEVHGEQPAGPGGEADGEGAGEGAGEAWEGAGDEEVAVQEAGPGGADGAVAVAEGGPFRPEGAGGLGDMGDTTPAEPPTPEGSPIIKRKLGVDGEEEELPPEPEPEPEPEPEKADAENGEKEEVPKPPPEPPKKTAPPPPPPKKEEGGSGGLEFWGELEVQRVKFLNYLSRNFYTLRFLALFLAFAINFILLFYKVSDSPPGEDDMEGSAAGDLSGAGSGGGSGWGSGAGEEVEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPEPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVREDMETKCFICGIGSDYFDTTPHRFETHTLEEHNLANYMFFLMYLINKDETEHTGQESYVWKMYQERCWDFFPAGDCFRKQYEDQLS

SEQ ID NO: 1888 - protein, 298 aa, Sus scrofa
MSDQAWSFLKDFLAGGVAAAISKTAVAPIERVKLLLQVQHASKQISAEKQYKGIIDCVVRIPKEQGFLSFWRGNLANVIRYFPTQALNFAFKDKYKQIFLGGVDRHKQFWRYFAGNLASGGAAGATSLCFVYPLDFARTRLAADVGKGAAQREFTGLGNCLAKIFKSDGLRGLYQGFNVSVQGIIIYRAAYFGVYDTAKGMLPDPKNVHIIVSWMIAQTVTAVAGLVSYPFDTVRRRMMMQSGRKGADIMYTGTVDCWRKIAKDEGPKAFFKGAWSNVLRGMGGAFVLVLYDEIKKYV

SEQ ID NO: 1889 - protein, 169 aa, Sus scrofa
MAPKKAKRRAAAEGSSNVFSMFDQTQIQEFKEAFTVIDQNRDGIIDKEDLRDTFAAMGRLNVKNEELDAMMKEASGPINFTVFLTMFGEKLKGADPEDVITGAFKVLDPEGKGTIKKHFLEELLTTQCDRFSQEEIKNMWAAFPPDVGGNVDYKNICYVITHGDAKDQE

SEQ ID NO: 1890 - protein, 417 aa, Sus scrofa
MSLSNKLTLDKLDVKGKRVVMRVDFNVPMKNNQITNNQRIKAAIPSIKFCLDNGAKSVVLMSHLGRPDGIPMPDKYSLEPVAVELKSLPGKDVLFLKDCVGPEVEKACADPAAGSVILLENLRFHVEEEGKGKDASGSKVKADPAKIEAFRASLSKLGDVYVNDAFGTAHRAHSSMVGVNLPKKAGGFLMKKELNYFAKALESPERPFLAILGGAKVADKIQLINNMLDKVNEMIIGGGMAFTFLKVLNNMEIGTSLFDEEGSKIVKDLMSKAEKNGVKITLPVDFVTADKFDENAKIGQATVASGIPAGWMGLDCGPESSKKYSEAVARAKQIVWNGPVGVFEWEAFAQGTKALMDEVVKATSRGCITIIGGGDTATCCAKWNTEDKVSHVSTGGGASLELLEGKVLPGVDALSNV

SEQ ID NO: 1891 - protein, 1089 aa, Sus scrofa
DADPLVMGAPGAPMDVHCHDANRDYVIVTWKPPNTTKESPVLGYFIDRCEVGTDNWVQCNDAPVKICKYPVSGLVEGRSYTFRVRAVNSAGVSRPSRASEAVAALDPLDLKRLQGIHWEGDKDIVIYQDDLEGEVQIPRPPTNVHASEISRTYVVLSWDPPTPRGKEPLMYFIEKSVVGSGTWQRENAQTAVRSPRYAVFDLAEGKSYVFRVLSANKHGLSDPSEITSPIQAQDTIVVPSAPGRVLASRNTKTSVVVQWDQPKHGEDLLGYYVDCCVAGSNVWEPCNHKPIGYNRFVVHGLTTGEQYIFRVKAVNAVGTSENSQESDVIKVQAALTVPSHPYGITLLNCDGHSMTLGWKVPKFSGGSPIIGYYVDKREGHHKNWHEVNSSPLKERILTVEGLTEGSTYEFKIAAANLVGIGLPSDPSELFKCEAWTAPEPGPAYDLTFCEVRDTSLVLLWKAPVYSGSSPVSGYFVDFKEEDSGEWNTVNEVATANRYLKVCDLHQGKTYVFRVRAVNANGVGKPSDTSEPVLVEARPGTKEISAGVDEEGNIYLSFDCQEMTDASHFTWCKSYEDIADDERFKVETVGDHSKLYFKHPDKVDLGTYSVSVSDTDGVSSSFVLDEEELERLMALSNEIKNPTIPLKSELAYEIFDKGQVRFWLQAEHLSPDASYRFVINDREVPDSETHRIKCDKSTGIVEMVMDRFTIENEGTYTVQIHDGKAKNQSSLVLIGDAFKAVLEEAEFQRKEFLRKQGPHFSEYLHWDVTEECEVRLVCKVANTKKETVFKWLKDDVLYETEKLPDLEKGVCELLIPKLSKKDHGEYKATLKDERGQDVSILEIAGKVYEDMILAMSRVCGASASPLKILCTPEGIRLQCFMKYFMEEMKVNWYHKDAKIASSEHMRIGGSEEMAWLQICEPTEKDKGKYTFEIFDGKNNHQRSLDLSGQAFDEAFAEFQQLKAAAFAEKNRGKVIGGLPDVVTIMEGKTLNLTCTVFGNPDPEVVWFKNDKDIELSEHFSVKVEQAKYVSMTIKGVTSEDSGKYSIHVKNKYGGEKIDVTVSVYKHGEEIPDVVLPQQAKPKLIPASASE

SEQ ID NO: 1892 - protein, 332 aa, Sus scrofa
MATLKDQLIHNLLKEEHVPHNKITVVGVGAVGMACAISILMKELADEIALVDVMEDKLKGEMMDLQHGSLFLRTPKIVSGKDYNVTANSRLVVITAGARQQEGESRLNLVQRNVNIFKFIIPNIVKYSPNCKLLVVSNPVDILTYVAWKISGFPKNRVIGSGCNLDSARFRYLMGERLGVHPLSCHGWILGEHGDSSVPVWSGVNVAGVSLKNLHPELGTDADKEHWKAVHKQVVDSAYEVIKLKGYTSWAIGLSVADLAESIMKNLRRVHPISTMIKGLYGIKEDVFLSVPCILGQNGISDVVKVTLTPEEEAHLKKSADTLWGIQKELQF

SEQ ID NO: 1893 - protein, 1140 aa, Sus scrofa
MPEAKPATKKAPAGKDAAKPAPKEAPPKGAPEEPPKEAPPEDQSPTAEEPTGIFLKKPDSVSVENGKDALIVAKVNGKELPGKPEIKWFKGKWLELGSKSGARFSFKESHDSASNVYTLELRIGKVVLGDRGDYRLEVKAKDFCDSCAFNIDVEAPRQDSAGQSLESFKRSGEGKPEGAGELDFSGLLKKRQVVEEEKKKKKDDDDLGIPPEIWELLKGAKKSEYEKIAFQYGITDLRGMLKRLKKAKVEVKKSAAFTKKLDPAYQVDQGNKIKLVVEISDPDLPLKWYKNGQEIKPSSKYVFENVGKKRILCINKCTLADDAAYEVAVKDEKCFTELFVREPPVLIVTPLEDQQVYVGDRVEMTVEVSEEGAQVMWLKDGVELTREDSFKSRYRFKKDGKRHILIYSDVSLEDRGRYQVMTNGGQCEAELSVEEKQLEVLQDIADLTVKASEQAVFKCEVSDEKVTGKWYKNGVEVRPSKRITISHVGRFHKLVIDDVRPEDEGDYTFVPDGYALSLSAKLNFLEIKVEYVPKQEPPKIHLDCSGKTSENAVVVVAGNKLRLDVSITGEPPPVATWMKEDEVFSGTEGRVRLEQRADISSFVIESAERGDEGRYTIKVTNPAGEDVASIFLRVVDVPDPPEAVRVTTVGEDWAILVWEPPKYDGGQPVTGYLLERKKKGSQRWMKLNFEVFTETTYESTNMIEGILYEMRVFAVNAIGVSQPSVNTKPFMPIAPTSEPQHLTVEDVTDTTTTLKWRPPDRIGAGGIDGYLVEYCVEGSDEWIPANTEPVERCGFTVKNLPTGARITFRVVGVNIAGRSQPATLAQPVTIREIVEQPKIRLPRHLRQTYIRKVGEHLNLVIPFQGKPRPQVVWTKGGAPIDTSRVHVRTSNFDTVFFVRQAARSDSGEYELSVQIENMKDTATVHIRVVEKAGPPQNVMVKEVWGTNALVEWQPPKDDGNTEITGYFVQKADKKTMEWFNVYEHNRHTSCTVSDLIMGNEYYFRVYSENICGLSDSPGVSKNTARILKTGITFKLPEFKEHDFRTPPKFLTPLPDRVVVAGYTAALNCAVRGHPKPKVVWMKNQMEIGEDPKFLMTNHQGVLTLNIRRPSPFDSGTYSCRAVNELGEALAECKLEVRVPQ

SEQ ID NO: 1894 - protein, 260 aa, Sus scrofa
MAKEWGYADHNGPDHWHELYPIAKGDNQSPIELHTKDIKHDPSLLPWTASYDPGSAKTILNNGKTCRVVFDDTYDRSMLRGGPLTAAYRLRQFHLHWGSSDDHGSEHTVDGVKYAAELHLVHWNSKYNSFATALKHPDGVAVVGIFLKIGREKGEFQLVLDALDKIKTKGKEAPFTNFNPSCLFPACRDYWTYHGSFTTPPCEECIVWLLLKEPITVSSDQMAKLRSLYSSAENEPPVPLVRNWRPPQPIKGRIVKASFK

SEQ ID NO: 1895 - protein, 253 aa, Sus scrofa
MATHRLVMVRHGESTWNQENRFCGWFDAELSEKGAEEAKRGAHAIKDAKMEFDICYTSVLKRAIRTLWTILDGTDQMWLPVVRTWRLNERHYGGLTGLNKAETAAKHGEEQVKIWRRSFDIPPPPMDEKHPYYSSISKERRYAGLKPGELPTCESLKDTIARALPFWNDEIAPQIKAGKRVLIAAHGNSLRGIVKHLEGMSDQAIMELNLPTGIPIVYELDQALKPTKPMRFLGDEETVRKAMEAVAAQGKAK

SEQ ID NO: 1896 - protein, 2640 aa, Sus scrofa
PKYREVWDKDKTSVHIMPDTPEINLARANALNVSNKIYREGWDEMKMSCDVRLDAIPIQAAKASREIASDYKYKLDHEKQKGHYVGTLTARDDNKIRWALIAGKIQNEREYRLHWAKWKSKFQSPADMLSITHSKNCQALVSDIDYRNYLHQWTCLPDQHDVIQARKAYDLQSDAIYKADLEWLRGIGWMPSDSVSVNHAKHAADIFSEKKYRTKIETLNFTPVDDRVDYVTAKQSGEILNDIKYRKDWNDTKSKYTLTETPQLHAAQEAARILDQYLYKESWEKQKATGYILPPDAVPFVHAHHSSDVQSELKYKADHVKQKGHYVGVPTMRDDPKLVWFEHAGQIQNDRLYKEHYHKTKAKINIPPDMVSVVAAKEGQILVSDIDYRNYLHQWTCHPDQNDVIQARKAYDLQSDNVYKADLEWLRGIGWIPLDSVDHVRVTRNQEMVNQIKYKKDALANYPNFTSVVDPPAVVLAKINSVNQSDVKYKETFNKLLKGKYIFSPDTPYITHSKDMGKLYSTILYKGAWEGTKAYGYTLDERYIPIVGAKHADFVNSELKYKETYEKQKGHYLAGKEISEFPNVVHCLDFQKMRSVLNYRRHYEDTKANVHIPNDMMNHVLAKRCQYILSDLEYRHYFHQWTSLPEEPNVIRARNAQEILSDNVYKDDLNWLKGIGCYVWDTPQILHAKKSYDLQSQILYTADGKENLKNYNMVTDTPLYVTALQSGINASEVKYKENYHQIKDKYTTVLETVDYDRTRNLKDLYSSNVYKEAWDKVKATSYILPSNTVSLTHAKNQKHLASHIKYREEYEKFKALYTLPKSVDDDPNTARCLRVGKFNIDRLYRSVYEKNKMKIHMVPDMVEMVTAKDSQKKVSEIDYRLHLHEWICHPDLQVNSHVRKVTDQISDIVYKDDLNWLKGIGCYVWDTPEILHAKHAYDLRNDIKYQAHVKKTRNNYKLVTDTPLYVQAVKSGKQLSDAVYHYDYVHSVRGKVAPTTKTVDLDRALHAYKLQSENLYRKDGLNSLPTGYRLPGDTPHFKHNKDIRYMSSYFKYKEVYEHFKANGYTLGPKDVPFVHVRRVNNVTSERLYRQLYHKLKDKIHTTPDTPEIRQVKKTQEAVSELIYKSDFFKMQGHMISMPYTPHVLHCRYVGDITSDIKYKEDLQLRGLGCFLYDTPDMRSRHLRKLWSNYLYTDNARKMRDKYKVVLDTPEYRKVQELKTHLSELVYRAAGKKQKSIFTSVPDTPDLLRAKRGQKLQSQYLYVELATKERPHHHAGNQTTALKHARDVKDMVSEKKYKVQYEKMKDKYTPVPDTPILIRAKKAYWNASDLRYKETFQKTKGKYHTVKDALDIVYHRKVTDHISKIKYKENYMSQLGIWRSIPDRPEHFHHRAVTDAVSDVKYKEDLTWLKGIGCYAYDTPDFTLAEKNKTLYSKYKYKEVFERTKSDFKYEADCPINRHFKFATQLMNEKKYRADYEQRKDKYQLVVDEPRHLLAKIAGDQISQIKYRKNYEKTKDKFTSVVDTPEHLRTTKVNKQISDILYKLEYNKAKPRGYTTIHDTPMLLHVRKVKDEVSDLKYKEVYQRTKSNCTIEPDAVHIKAAKDAYKVNTNLDYKKQYEANKAHWRWTPDRPDFIQAAKSSLQQSDFEYKLDREFLKGCKLSVTDDKDMVLALRNSVIESDLKYKEKHVKERGTCHAVPDTPQILLAKTVSNLVSENKYKRHVKKHLAQGSYTTLPETRDTVHVKEVTKHVSDTNYKKKFVKERGKSNYSIMLEPPEVKHAMEVAKKQSDVAYKKDAKENLHYTTVADRPDIKKATQAAKQASEVEYRAKHRKEGSHGLSMLGRPDIEMAKKAATLSSQVKYRENFKEKGKTPKYNPKESQLYKIMKDANNLASEVKYKADLKKLHKPVTDMKESLIMNHVLNTSHLASSYQYKKNYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLSEMEDTPDMLRAKNATQILNEKEYKRDLELEVKGRGLNAMANETPDFMRARNATDIASQIKYKQLAEMEKANFTSVVDTPEIIHAQQVKNLSSQKKYKEDAEKCMSYYETVLDTPEMQRVRENQKNFSLLQYQCDLKNSKGKITVVQDTPEILRVKENQKNFSSVLYKEDVSPGTAIGKTPEMMRVKQTQDHISSVKYKETIGQGTPIPDLPEVKRVKETQKHISSVMYKENLGTGIPTPVTPEIERVKRNQENFSSVLYKENMGKGTPLPVTPEMERVKHNQENISSILYKENVGKGTPTPVTPEMQRVKRNQENISSVLYSDSFRKQIQGKAAYVLDTPEMQRVRETQRHISTVKYHEDFEKHKGCFTPVVTDPITERVKKNTQDFSDINYRGIQRKVVEMEQKRNDQDQETITGLRVWRTNPGSVFDYDPAEDNIQSRSLHMLNAQAQRRSREQSRSASALSISGGEEKSEHSEAARLSTYSDGGVFFSATSAAYKHAKTTELPQQRSSSVATQQTTVSSIPSHPSTAGKIFRAMYDYMAADADEVSFRDGDAIVNVQAIDEGWMYGTVQRTGRTGMLPANYVEAI

SEQ ID NO: 1897 - protein, 471 aa, Sus scrofa
MSQAYSSSQRVSSYRRTFGGAPSFPLGSPLSSPVFPRAGFGTKGSSSSVTSRVYQVSRTSGGAGGLGPLRASRLGATRVPSSSYGAGELLDFSLADAVNQEFLTTRTNEKVELQELNDRFANYIEKVRFLEQQNAALAAEVNRLKGREPTRVAEIYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTFSALNFRETSPEQRGSEVHTKKTVMIKTIETRDGEVVSEATQQQHEVL

SEQ ID NO: 1898 - protein, 562 aa, Sus scrofa
MVKIVTVKTKAYQDQKPGTSGLRKRVKVFQSSANYAENFIQSIISTVEPAHRQEATLVVGGDGRFYMKEAIQLIVRIAAANGIGRLVIGQNGILSTPAVSCIIRKIKAIGGIILTASHNPGGPNGDFGIKFNISNGGPAPEAITDKIFQISKTIEEYAICPDLKVDLGVLGKQQFDLENKFKPFTVEIVDSVEAYATMLRNIFDFNALKELLSGPNRLKIRIDAMHGVVGPYVKKILCEELGAPANSAVNCVPLEDFGGHHPDPNLTYAADLVETMKTGEHDFGAAFDGDGDRNMILGKHGFFVNPSDSVAVIAANIFSIPYFQQTGVRGFARSMPTSGALDRVANATKIALYETPTGWKFFGNLMDASKLSLCGEESFGTGSDHIREKDGLWAVLAWLSILATRKQSVEDILKDHWQKYGRNFFTRYDYEEVEAEGANKMMKELEALISDRSFVGKQFPVGDKVYTVEKIDNFEYSDPVDGSISRNQGLRVIFADGSRIIFRLSGTGSAGATIRLYIDSYEKDLAKIYQDPQVMLAPLISIALKMSQLQERTGRTAPTVIT

SEQ ID NO: 1899 - protein, 780 aa, Sus scrofa
MTHEEHHAAKSLGVGKAIAVLTSGGDAQGMNAAVRAVVRVGIYTGARVFFVHEGYQGLVDGGDNIREATWESVSMMLQLGGTVIGSARCKDFREREGRLRAAHNLVKRGITNLCVIGGDGSLTGADTFRSEWGDLLNDLQKAGKITAEEANKSSYLNIVGLVGSIDNDFCGTDMTIGTDSALHRIIEIVDAITTTAQSHQRTFVLEVMGRHCGYLALVTSLSCGADWVFIPECPPDDAWEEHLCRRLSETRTRGSRLNIIIVAEGAIDKNGQLITSENIKDLVVKRLGYDTRVTVLGHVQRGGTPSAFDRILGSRMGVEAVMALLEGTPDTPACVVSLSGNQAVRLPLMECVQVTKDVTKAMNEKRFDEAMKLRGRSFMNNWEVYKLLAHVRPPVTKSGSYTVAVMNVGAPTAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQYDELCIPFVVIPATVSNNVPGSDFSVGADTALNTICMTCDRIKQSAAGTKRRVFIIETMGGYCGYLATMAGLAAGADAAYIFEEPFTIRDLQVNVEHLVQKMKTTVKRGLVLRNEKCNENYTTDFIFNLYSEEGKGIFDSRKNVLGHMQQGGSPTPLDRNFATKMGAKAMNWMSGKIKESYRNGRIFANTPDSGCVLGMRKRALVFQPVTELKEQTDFEHRIPKEQWWLKLRPILKILAKYEIDLDTSEHAHLEHITRKRSGEATI

SEQ ID NO: 1900 - protein, 1659 aa, Sus scrofa
MSLPFYQKLHQHYDRSYRNKDLRTTMSQYQQEKRSSAIYTHGSTAYSARSSAAHRQESEAFSQASTTSYQQQASRASELALSSSVSQKAASAYNYGYSRGRTDSSLMLEDYSSKLSPQIKRARKGLLSGEEKENLPSDYMVPIFSGRQVHVSGITDTEEERIKEAAAYIAKRKLLASEEGITAAKQSTVSKQSTSTLHQEEAFEKKSRKVAIREKAEHLELRKTLEETEAYHRKLNEDNLLHAPEFVIKPRSHTVWEKENVKLHCSVAGWPEPRVTWYKNQVPINVHANPGKYIIESRYGMHTLEINACDFEDTAQYRASAMNVKGELSAYASVVVKRYKGEFDETRFHAGVSTLPLSFAVTPYGYASKFEIHFDDKFDVSFGREGETMSLGCRVVITPDIKHFQPEVQWYRNGAPVSPSKWVQTHWSGDRATLTFSHLNKEDEGLYTIRVRMGDYYEQYSAYVFVRDADAEIEGAPASPLDVVCLDANKDYIIISWKQPAVDGGSPILGYFIDKCEVGTNNWSQCNDTPVKFARFPVTGLIEGRSYIFRVRAVNKNGIGLPSRVSEPVAALDPAEKARLRSRPSAPWTGQIIVTEEEPTEGIVPGPPTDLSVIEATQSYVVLSWKPPKQRGHEGILYFIEKCDAGAENWQRVNTELPVKSPRFALFDLAEGKSYQFRVRCSNSAGVGEPSEATEVTVVGDKLDIPKAPSNIIPSRNTDTSVVVTWEESKDAKELVGYYIESSVVGSGKWEPCNNNPVKGTRFTCHGLTTGQSYIFRVRAVNAAGLSEYSQDSEAIEVKAAIVVGGAVSPAVWPELSDTPGGLTDFRGGMHDTSQPTFKKDALLGSKLNKASLPSSSHNLGQTEVRKVSETVQEELSPPPQKAAVKGKSKSDPLKKKKDLATAAPSPPCDITCLESFRDSMVLGWKQPDKTGGAEITGYYVNYREVIDGVPGRWREANIKAISDEAYKISNLKENMVYQFQVAAMNIAGLGEPSAVSASFKCEEWTIAVPGPPHSLKYSEVRNTSLVLQWKPPIHSGRTPVTGYFVDMKEANAKEDHWRGLNEAALKNTYLKVQGLKEGVSYVFRVRAINQAGVGKPSDLAGPVVAETRPGTKEVVVSVDDDGIISLNFECDQMAPNSEFTWSKDYVPTEDSPRLEVESKGNKTKMTFKDLGVEDLGIYSCDVTETDGIAASYLIDEEELKRLLALSQEHKFPTVPIKSELAVEILEKGQVRFWMQAEKLSGNAKVNFIFNDKEIFEGPKYKMHIDRNTGMIEMFMEKLQDEDEGTYTFQVQDGRATGHSTLVLIGDVYKKLQKEAEFQRQEWIRKQGPHFAEYLSWEVTGECNVLLKCKVANIKKETHIVWYKDEREISVDEKHDFKDGICTLLITEFSKKDAGIYEVILKDDRGKDKSRLKLVDEAFKELMTEVCKTIALSATDLKIQSTAEGIRLYSFVTYYVDDLKVNWSHNGAAIKYTDRVKSGVTGEQIWLQINEPTPNDKGKYVMELFDGKTGHQKMVDLSGQAYEEAFAEFQRLKQAAIAEKNRARVVGGLPDVVTIQEGKALNLTCIVWGDPTPEVSWLKNEKLLASDEHCNLRFEAGKTAYFTISGVRTSDSGRYGLVVKNKYGSETSDFTVSVFIPEEEARQGVEEPPKGHKGNKKSP

SEQ ID NO: 1901 - protein, 298 aa, Sus scrofa
MPLSGTPAPNKKRKSSKLIMELTGGGQESSGLNLGKKISVPRDVMLEELSLLTNRGSKMFKLRQMRVEKFIYENHPDVFSDSSMDHFQKFLPTVGGQLGTAGQGFSYSKGSSGGQAGGSSSAGQYGSGQQHHHQGSGSGSGGAGGPGSQTGRGGDAGTTGVGETGTGDQAGGEGKHITVFKTYISPWEKAMGVDPHQKVELGIDLLAYGAKAELPQYKSFNRTAMPYGGYEKASKRMTFQMPKFDLGPLLSEPLVLYNQNLSNRPSFNRTPIPWLSSGEPVDYNVDIGIPLDGETEEL

SEQ ID NO: 1902 - protein, 271 aa, Sus scrofa
MSDEEVEHVEEEYEEEEEAQEEAPPPPAEVHEVHEEVHEVHEPEEVQEEEKPRPKLTAPKIPEGEKVDFDDIQKKRQNKDLMELQALIDSHFEARKKEEEELVALKERIEKRRAERAEQQRIRAEKERERQNRLAEEKARREEEEAKRRAEDDLKKKKALSSMGANYSSYLAKADQKRGKKQTAREMKKKVLAERRKPLNIDHLSEDKLRDKAKELWDALYQLEIDKFEYGEKLKRQKYDIINLRSRIDQAQKHSKKAGTTPKGKVGGRWK

SEQ ID NO: 1903 - protein, 360 aa, Sus scrofa
VSSVAHLARANPFIAPHLQLVQDGLAGPRSSPDGPPGPPRRTRNLAAAAVEEYSCEYGSMKFYALCGFGGVLSCGLTHTAVVPLDLVKCRMQVDPNKYKGIFNGFSITLKEDGVRGLAKGWAPTFIGYSLQGLCKFGFYEVFKVLYSNMLGEENAYLWRTSLYLAASASAEFFADIALAPMEAAKVRIQTQPGYANTLRDAAPKMYQEEGLKAFYKGVAPLWMRQIPYTMMKFACFERTVEALYKFVVPKPRSECSKPEQLVVTFVAGYIAGVFCAIVSHPADSVVSVLNKEKGSSASQVLRRLGFRGVWKGLFARIIMIGTLTALQWFIYDSVKVYFRLPRPPPPEMPESLKKKLGYTQ

SEQ ID NO: 1904 - protein, 421 aa, Sus scrofa
ARAAARHYADQRIKVAKPVVEMDGDEMTRIIWQFIKEKLILPHVDVQLKYFDLGLPNRDQTNDQVTIDSALATQKYSVAVKCATITPDEARVEEFKLKKMWKSPNGTIRNILGGTVFREPIICKNIPRLVPGWTKPITIGRHAHGDQYKATDFVVDRAGTFKIVFTPKDGSSAKQWEVYNFPAGGVGMGMYNTDESISGFAHSCFQYAIQKKWPLYMSTKNTILKAYDGRFKDIFQEIFEKHYKTDFDKYKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQTLEKVCVETVESGAMTKDLAGCIHGLSNVKLNEHFLNTSDFLDTIKSNLDRALGRQ

SEQ ID NO: 1905 - protein, 2720 aa, Sus scrofa
MMNNSGYSEAAGLGLGDEVDDMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPVMEGPHTVHVAFAGAPITRSPFPVHVAEACNPNACRASGRGLQPKGVRVKEVADFKVFTKGAGSGELKVTVKGPKGTEEPVKVRDAGDGVFECEYYPVVPGKYVVTITWGGYAIPRSPFEVQVSPEAGMQKVRAWGPGLETGQVGKSADFVVEAIGTEVGTLGFSIEGPSQAKIECDDKGDGSCDVRYWPTEPGEYAVHVICDDEDIRDSPFIAHIQPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVHFAGAAKGEAVRDFEIIDNHDYSYTVKYTAVQQGNMAVTVTYGGDPVPKSPFVVNVAPPLDLSKVKVQGLNSKVAVGQEQAFSVNTRGAGGQGQLDVRMTSPSRRPIPCKLEPGGGADAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKAGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDDVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLSPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGEETVITVDAKAAGKGKVTCTVSTPDGAELDVDVVENHDGTFDIYYTAPEPGKYVITIRFGGEHIPNSPFHVLACDPMPHVEEPSEVLQLHRPSAYPTHWATEEPVVPVESMESMLRPFNLVIPFTVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGQTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKTEAAEIVEGEDSAYSVRFVPQEMGPHTVTVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHVGNRVYNVTYTVKEKGDYILIVKWGDESVPGSPFKVNVP

SEQ ID NO: 1906 - protein, 419 aa, Sus scrofa
MASTFSKLLTGRNASLLFATLGTGALTTGYLMNQRSVCAEAREQHRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHPTDLDASKITQGQFDERYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKDPRFSKILENLRLQKRGTGGVDTAAVADVYDISNIDRIGRSEVELVQIVIDGVNYLVDCEKKLERGQDIKVPPPLPQFSRK

SEQ ID NO: 1907 - protein, 558 aa, Sus scrofa
MAALTQNPQFKKLQTWYHEHRSDLNLRRLFEGDKDRFNHFSLNLNTNHGRILLDYSKNLVTEAVMQMLVDLAKSRGVEAARERMFNGEKINFTEDRAVLHVALRNRSNTPILVDGKDVMPEVNRVLEKMKSFCKRVRSGEWKGYSGKSITDVINIGIGGSDLGPLMVTEALKPYSAEGPRVWFVSNIDGTHIAKTLATLNPESSLFIIASKTFTTQETITNAETAKEWFLQSAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINFFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMKGKSTEEARKELQAAGKSPEDFEKLLPHKVFEGNRPTNSIVFTKLTPFILGALIAMYEHKIFVQGVIWDINSFDQWGVELGKQLAKKIEPELDGSSPVTSHDSSTNGLINFIKQEREARSQ

SEQ ID NO: 1908 - protein, 284 aa, Sus scrofa
MDAIKKKMQMLKLDKENAIDRAEQAEADKKQAEDRCKQLEEEQQALQKKLKGTEDEVEKYSESVKDAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESRARQLEEELRTMDQALKSLMASEEEYSTKEDKYEEEIKLLEEKLKEAETRAEFAERSVAKLEKTIDDLEETLASAKEENVEIHQTLDQTLLELNNL

SEQ ID NO: 1909 - protein, 533 aa, Sus scrofa
VSKNALGSSFVAARNLHASNTRLQKTGTAEVSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGTDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYAPMAIEEQVAVIYAGVRGYLDKLEPSKITKFENAFLSHVISQHQALLGKIRADGKISEETDAKLKEIVTNFLAGFEA

SEQ ID NO: 1910 - protein, 781 aa, Sus scrofa
MAPYSLLVTRLQKALGVRQYHVASVLCQRAKVAMSHFEPHEYIRYDLLEKNIDIVRKRLNRPLTLSEKIVYGHLDDPANQEIERGKTYLRLRPDRVAMQDATAQMAMLQFISSGLPKVAVPSTIHCDHLIEAQLGGEKDLRRAKDINQEVYNFLATAGAKYGVGFWRPGSGIIHQIILENYAYPGVLLIGTDSHTPNGGGLGGICIGVGGADAVDVMAGIPWELKCPKVIGVKLTGSLSGWTSPKDVILKVAGILTVKGGTGAIVEYHGPGVDSISCTGMATICNMGAEIGATTSVFPYNHRMKKYLSKTGRADIANLADEFKDHLVPDPGCHYDQVIEINLSELKPHINGPFTPDLAHPVAEVGSVAEKEGWPLDIRVGLIGSCTNSSYEDMGRSAAVAKQALAHGLKCKSQFTITPGSEQIRATIERDGYAQVLRDVGGIVLANACGPCIGQWDRKDIKKGEKNTIVTSYNRNFTGRNDANPETHAFVTSPEIVTALAIAGTLKFNPETDFLTGKDGKKFKLEAPDADELPRAEFDPGQDTYQHPPKDSSGQRVDVSPTSQRLQLLEPFDKWDGKDLEDLQILIKVKGKCTTDHISAAGPWLKFRGHLDNISNNLLIGAINIENRKANSVRNAVTQEFGPVPDTARYYKQHGIRWVVIGDENYGEGSSREHRALEPRHLGGRAIITKSFARIHETNLKKQGLLPLTFADPADYNKIHPVDKLTIQGLKDFAPGKPLKCIIKHPNGTQETILLNHTFNETQIEWFRAGSALNRMKELQQK

SEQ ID NO: 1911 - protein, 894 aa, Sus scrofa
EVQAKAGASTTLSCEVAQAQTEVTWYKDGKKLSASSKVHVEAKGCTRRLVVQQVGKADAGEYSCEAGGQKVSFHLDVTEPEPELAALERPRRREPLVVKEHEDIVLTATLATPSVAAVTWLKDGVEIRRSKRHEMASLGETHTLTVHGAQTLDSAVYSCRVGAEGQDFPVQTDVPSPPSEVAAKFCRPLESVSGELGGTVTLTCELSPAQAEAVWRCGNTQLRAGKRFQMAAAGLQRSLTVTGLRAEDAGEYVCQSRDDRTSATLTVRVPRMVKFTSPLSAVVAEEGCEANFQCVVTPSDVAVTWFRDGLQLQLSEKFLISQRGASHSLTISSLALEDSGQITAEAEGVKSTAALRVREAPVLFKKKLEPQTVEERSSVTMAVELTRQWPEVKWTRNAAALVPGENVEIHAEGESHRLVLHSVGFADRGFYGCETPDDKTQAKLTVEMRQVRLVRGLQAVEAQEQGVATMEVELSHADVEGSWTRDGLRLQPGPTCQLAVHGPTHSLTLSQLQRQDGGLVTFRAEGVHTSAQLVVTELPVKFSRPLQDVVATEKDKVILDCELSRPNVDVRWLKDGVELRLSKTVGMVAQGSCRSLIIYRCELGDQGVYMCDAHDAQTSASLKVQGRNVQIVRPLEDVEVMEKEGATFSCEVSHDEVPAHWFREGIKLRPTDNVRIRQEGRTYTLIYRRVLVGDAGEIKFVAENAESRAQLRVKELPVAILRPLRDKIAMEKHRGVLECQMSRASAQVRWFKGSVELQPGAKYEMISDGLYRKLVINAVQPEDEDTYTCDAGDVKTSAQFFVEEQSITIVRGLQDVTVMEPAPAWFECELSIPSVRPPKWLLGKTVLQAGADVGIEQEGTVHRLTLRRTFSTMTGPVHFTIGKSRSTASLVVSG

SEQ ID NO: 1912 - protein, 141 aa, Sus scrofa
VLSAADKANVKAAWGKVGGQAGAHGAEALERMFLGFPTTKTYFPHFNLSHGSDQVKAHGQKVADALTKAVGHLDDLPGALSALSDLHAHKLRVDPVNFKLLSHCLLVTLAAHHPDDFNPSVHASLDKFLANVSTVLTSKYR

SEQ ID NO: 1913 - protein, 147 aa, Sus scrofa
MVHLSAEEKEAVLGLWGKVNVDEVGGEALGRLLVVYPWTQRFFESFGDLSNADAVMGNPKVKAHGKKVLQSFSDGLKHLDNLKGTFAKLSELHCDQLHVDPENFRLLGNVIVVVLARRLGHDFNPNVQAAFQKVVAGVANALAHKYH

SEQ ID NO: 1914 - protein, 175 aa, Sus scrofa
MDIAIHHPWIRRPFFPFHSPSRLFDQFFGEHLLESDLFPASTSLSPFYFRPPSFLRAPSWIDTGLSEMRLEKDRFSVNLDVKHFSPEELKVKVLGDVIEVHGKHEERQDEHGFISREFHRKYRIPADVDPLTITSSLSSDGVLTVNGPRRQASGPERTIPITREEKPAVTAAPKK

SEQ ID NO: 1915 - protein, 227 aa, Sus scrofa
MGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGPPGPAGARGNDGATGAAGPPGPTGPAGPPGFPGAVGAKGEAGPQGARGSEGPQGVRGEPGPPGPAGAAGPAGNPGADGQPGGKGANVSILKVS

SEQ ID NO: 1916 - protein, 187 aa, Sus scrofa
MPETQRKPKITASRKLLLKSLMLAKAKECWEQEHEEREAEKARYLAERIPTLQTRGLSLSALQDLCRELHAKVEVVDEERYDIEAKCLHNTREIKDLKLKVLDLRGKFKRPPLRRVRVSADAMLRALLGSKHKVSMDLRANLKSVKKEDTEKERPVEVGDWRKNVEAMSGMEGRKKMFDAAKSPTSQ

SEQ ID NO: 1917 - protein, 163 aa, Sus scrofa
MEIPVPVQPSWLRRASAPLPGLSAPGRLFDQRFGEGLLEAELAALCPATLAPYYLRAPSVALPTAQVPTDPGHFSVLLDVKHFSPEEIAVKVVGEHVEVHARHEERPDEHGYIAREFHRRYRLPPGVDPAAVTSALSPEGVLSIQAAPAPAQGPLPSPPAAAK

SEQ ID NO: 1918 - protein, 165 aa, Sus scrofa
SPKKAKKRADGANSNVFSMFEQTQIQEFKEAFTIMDQNRDGFIDKNDLRDTFAALGRVNVKNEEIDEMIKEAPGPINFTVFLTMFGEKLKGADPEETILNAFKVFDPEGKGVLRADYVKEMLTTQAERFSKEEIEQMFAAFPPDVTGNLDYKNLVHIITHGEEKD

SEQ ID NO: 1919 - protein, 338 aa, Sus scrofa
  MOD_RES (21)..(21): Any amino acid
MLSALARPAGAALRRSFSTSXQNNAKVAVLGASGGIGQPLSLLLKNSPLVSRLTLYDIAHTPGVAADLSHIETRATVKGYLGPEQLPDCLKGCDVVVIPAGVPRKPGMTRDDLFNTNATIVATLTAACAQHCPDAMICIISNPVNSTIPITAEVFKKHGVYNPNKIFGVTTLDIVRANAFVAELKGLDPARVSVPVIGGHAGKTIIPLISQCTPKVDFPQDQLSTLTGRIQEAGTEVVKAKAGAGSATLSMAYAGARFVFSLVDAMNGKEGVVECSFVKSQETDCPYFSTPLLLGKKGIEKNLGIGKISPFEEKMIAEAIPELKASIKKGEEFVKNMK

SEQ ID NO: 1920 - protein, 334 aa, Sus scrofa
MSEPIRVLVTGAAGQIAYSLLYSIGNGSVFGKDQPIILVLLDITPMMGVLDGVLMELQDCALPLLKDVIATDKEEIAFKDLDVAILVGSMPRRDGMERKDLLKANVKIFKCQGAALDKYAKKSVKVIVVGNPANTNCLTASKSAPSIPKENFSCLTRLDHNRAKAQIALKLGVTSDDVKNVIIWGNHSSTQYPDVNHAKVKLQAKEVGVYEAVKDDSWLKGEFITTVQQRGAAVIKARKLSSAMSAAKAICDHVRDIWFGTPEGEFVSMGIISDGNSYGVPDDLLYSFPVTIKDKTWKIVEGLPINDFSREKMDLTAKELAEEKETAFEFLSSA

SEQ ID NO: 1921 - protein, 364 aa, Sus scrofa
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALNDHHVYLEGTLLKPNMVTPGHACPIKYSPEEIAMATVTALRRTVPPAVPGVTFLSGGQSEEEASLNLNAINRCPLPRPWALTFSYGRALQASALNAWRGQQDNAGAATEEFIKRAEVNGLAAQGKYEGGGEDGGAAAQSLYIANHAY

SEQ ID NO: 1922 - protein, 528 aa, Sus scrofa
MLGFVGRVASASASGALRGLSPSAPLPQAQLLLRAAPAALQPARDYATQPSPSPKAGAATGRIVAVIGAVVDVQFDEGLPPILNALEVQGRETRLVLEVAQHLGESTVRTIAMDGTEGLVRGQKVLDSGAPIKIPVGPETLGRIMNVIGEPIDERGPIKTKQFAAIHAEAPEFMEMSVEQEILVTGIKVVDLLAPYAKGGKIGLFGGAGVGKTVLIMELINNVAKAHGGYSVFAGVGERTREGNDLYHEMIESGVINLKDATSKVALVYGQMNEPPGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHLGKLVPLKETIKGFQQILAGEYDHLPEQAFYMVGPIEEAVAKADKLAEEHS

SEQ ID NO: 1923 - protein, 879 aa, Sus scrofa
SNHLELQVSASGGTEDVGNLLENHFSAGDASIEEKERALQAEAAPRETNQLLHPPDGGEAGSSEKTAPGGPAAHGLGSDPEAGLSNASASEPAPPGEPAGPGEEDAGPPGAGALPPGGEEEPGEEGRPELSSGEGSGQEAEKQAGSGEVPEDALEDRPAEGAAAGTPEPEDAGASPSTEMESGGEGSPGPDQEPEVPDGPADADAEAGDRGKDPGEPSPSPASDVGADVGGAQEDGAPEGPPEEQPDAASSEEEGGEDRSGEEEGGVPSQEESEEDSGDGASSEEADSASEEEEEEEAAAAEEAQGAAGSASGEEEGAPPSPEEPHAGPEGEGTQGDRQGPAGRGEPQPPRAAYEPLTPAGGQGGKKQPKGTGRHWRSPKSMPPHHPKSFVQSAQVETAQILEARECEQPSLGASGGHGHLLLLFSEEAEDVSEEAPLRDRSHIEKTLMLNEDKPSDDFSVVLQRLRKIYHSSIKPLEQSYKYNELRQHEITDGEITSKPMVLFLGPWSVGKSTMINYLLGLENTRYQLYTGAEPTTSEFTVLMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADNLATQMLMRVYGALFWSLAPLINVTEPPRVYVSSFWPYDYKPDTHRDLFLREEISLLEDLNQVIENRLENKIAFIRQHAIRVRIHALLVDRYLQTYKDKMTFFSDGELVFKDIVEDPDKFYIFKTILAKTNVSKFDLPNREAYKDFFGINPISGFKLLSQQCSYMGGCFLEKIERAITQDLPGLLGSLGLGKNPGALNCDKTGCGEAPKNRYRRP

SEQ ID NO: 1924 - protein, 147 aa, Sus scrofa; identical to SEQ ID NO: 854

SEQ ID NO: 1925 - protein, 221 aa, Sus scrofa
MGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGPKGADGAPGKDGVRGLTGPIGPPGPAGAPGDKGETGPSGPAGPTGARGAPVSTEDPIKAPYSALLSLRTNPWLSFCPSSTLVPTGSC

SEQ ID NO: 1926 - protein, 230 aa, Sus scrofa
QGVDEGPDGLKLISEVIGERLGIPMSVLMGANIANEVADEKFCETTIGCKDLAQGQLLKELMQTPNFRVTVVQEVDTVEICGALKNIVAVGAGFCDGLGFGDNTKAAVIRLGLMEMIAFAKLFCHGPVSSATFLESCGIADLITTCYGGRNRKVAEAFARTGKSIEQLEKEMLNGQKLQGPQTAQELHSILQHKGLVDKFPLFMAVYKICYENHPVSEFICCLQNHPEHS

SEQ ID NO: 1927 - protein, 461 aa, Sus scrofa; identical to SEQ ID NO: 733

SEQ ID NO: 1928 - protein, 478 aa, Sus scrofa
MSAAPGLLHQELSCPLCLQLFDAPVTAECGHSFCRACLGRVAGEPAADGTVLCPSCQAPTRPQALSTNQQLARLVEGLAQVPQGHCEEHLDPLSIYCEQDRVLVCGVCASLGSHRGHRLLPAAEAHARLKTQLPQQKLQLQEACMRKEKSVGVLEQQLVEVEETVRQFRGAVGEQLGKMRLFLAALEGSLDREAERVRGEAGVALRRELGSLKSYLEQLRQMEKVLEEVADKPQTEFLMKYCLVTSRLQKILAESPPPARLDIQLPVISDDFKFQVWRKMFRALMPAMQELTFDPSTAHPSLVLSASGRRVECSEQKAPPAGEDPRQFDKAVAVVTHQLLSEGEHYWEVEVGDKPRWALGVIGAQAGRRGRLHAVPSQGLWLLGLREGKILEAHVEAKEPRALRTPERRPSRIGIYLSFADGVLSFYDASDADALELLFAFHERLPGPVYPFFDVCWHDKGKNAQPLLLVGPDSGGEA

SEQ ID NO: 1929 - protein, 725 aa, Sus scrofa
MALSSWSPELGFGGSEKALKAAATVSTGPSLELCTFPSTLGSSVAAAALEQLFVVEQSLQSDYFKCDEEAKTFLKDVAIAVKKLEEMRKTTIDLLEIESMELSRLYFLLETIPNSVSRELEECVRDARRLNLFEINQLHLKITRINNEIEFWKKKILDLKKMNTTLGEQQELLSRQHEKIVLSLNQAMKEKATTTVYINETYTQINSEKEELELQKLYLQEVEEQMEKEKAEYLKRKKQLSQEIEEYKELCEFKRKETYKKKKELDKLKLKVTKMRETVTTSTVVLSDHNLEIARLQESIKSWEKQVEDMKKSCKNLEDKMLFFRTNKEKLDDASNVEKSELLLKIKQVAEKLNNCRLENKDLQERLNTVTRQYKIVLNEENKVFMQKRKIHVENQKQLAFIAQKENFLSKRRVDIKNMEEGLITLNDLHRATKEVYQKQIRVLSDNRQREHERCIITQWKKACLLKKHTRWAIQIKAEIQEIIGEIQDAELRRSGLLQETSFREKEIHEFLAQIEQLTLQLKQEEEEFVVKEKKLIQELSMYEQRFVQEAQINKVKEDELVECLPQLHVAEEEYMDKNKKFEELTDVITAQKQDHNLLNDLISQLSRDFLQYLNNAKKVKQELKQLRDNESHRIKTHFEILKNLEYEIYVHDLKTDALLLENKRLKEYIEYMKKNIEKYKNEEDLRCTSSDLFCQLTALNTQYSDLWAEFKTTLKGQDSREVAE

SEQ ID NO: 1930 - protein, 1318 aa, Sus scrofa
MGHSKQIRILLLNEMEKLEKTLFRLEQGFELQFRLGPTLQGKPVTVYTNYPYPGEAFNREKFRSLEWENPTEREDDSDKYCKLNLQQAGSFQYYFLQGNEKSGGGYIVVDPILRVGADNHVLPLDCVTLQTFLAKCMGPFDEWESRLRVAKESGYNMIHLTPLQTLGLSRSCYSLADQLELNPDFSRPNKKYTWTDVGQLVEKLKKEWNMLCITDVVYNHTAANSRWLHEHPESAYNLVNSPHLKPAFVLDRALWHLSSDVAEGRYKERGVPALIENDHHMNCIRKIIWEDIFPKIQLWEFFQVDVNKAVEQFRGLLTQENRKTTKPDPKQHLKIIQDPEYRRLGCAVDMNIALATFIPHDNGPAAIDECCNWFRKRIEELNSEKHQLVNYHQEQAVNCLLGNVFYERLAGHGPKLGPVTRKHPLVTRYFTYPFEEVSLAAEESMIHVPNKACFLMAHNGWVMGDDPLRNFAEPGSDVYLRRELICWGDSVKLRYGKKPQDCPYLWEHMKKYTEITATYFQGVRLDNCHSTPLHVAEYMLDAARKLQPNLYVVAELFTGSEDLDNIFVTRLGISSLIREAMSAYNSHEEGRLVYRYGGEPVGSFVQPCLRPLMPAIAHALFMDITHDNECPIVHRSAYDALPSSTIVSMACCASGSTKGYDELVPHQISVVSEERFYTKWNPAASPSDTGEVNFQSGIIAARCAINKLHQELGAKGFIQVYVDQVDEDIVAVTRHSPSIHQSVVSVSRTAFRNPKTSFYSKEVPQMCIPGKIEEVVLEARTVERNTKPYRKDENSINGMPNITVEIREHIQLNESKIVKQAGVTTKGPNEYIQEIEFENLSPGSVIIFRVSLDPHAQVAVGILRNHLTQFSPHFKSGSLAVDNADPILKIPFASIASKLTLAELNQVLYRCESEEQEDGGGCYNIPNWSPLKYAGLQGLMSVMAEIRPRNDLGHPFCDNLRSGDWMIDYVSNRLISRSGTIAEVGKWLQAMFFYLKQIPRYLIPCYFDAILIGAYTTLLDTAWKQMSSFGQNGSNLFETPFTGSVQMCGSRKIPSLALLPSLYDVPYRLNEITREKEQCCVSLAAGLPHFSSGIFRCWGRDTFIALRGLLLITGRYLEARNIILAFAGTLRHGLIPNLLGEGTHARYNCRDAVWWWLQCIQDYCKTVPNGLDILQCPVSRMYPTDDSVPLSAGTLDQPLFEVIQEAMQRHMQGIQFRERNAGPQIDRNMKDEGFNITAGVDEETGFVYGGNRLNCGTWMDKMGESDRARNKGIPATPRDGSAVEIVGLSKSAVRWLLELSKKNIFPYHEVTVKRHGKL

SEQ ID NO: 1931 - protein, 363 aa, Salmo salar
MPHAFPFLTPDQKKELSDIALKIVAKGKGILAADESTGSVAKRFQSINTENTEENRRLYRQLLFTADDRAGPCIGGVIFFHETLYQKTDAGKTFPEHVKSRGWVVGIKVDKGVVPLAGTNGETTTQGLDGLYERCAQYKKDGCDFAKWRCVLKITSTTPSRLAIMENCNVLARYASICQMHGIVPIVEPEILPDGDHDLKRTQYVTEKVLAAMYKALSDHHVYLEGTLLKPNMVTAGHSCSHKYTHQEIAMATVTALRRTVPPAVPGVTFLSGGQSEEEASINLNVMNQCPLHRPWALTFSYGRALQASALKAWGGKPGNGKAAQEEFIKRALANSLACQGKYVASGDSAAAGDSLFVANHAY

SEQ ID NO: 1932 - protein, 334 aa, Salmo salar
MVKVGVNGFGRIGRLVTRAAFHSKKGVEIVAINDPFIDLDYVVYMFKYDSTHGRFHGEVKAEGGKLVIDGHKITVFHERDPANIKWGDAGATYVVESTGVFTTIEKASTHLKGGAKRVVISAPSADAPMFVMGVNHEKYDNSLKVVSNASCTTNCLAPLAKVIHDNYHIIEGLMSTVHAVTATQKTVDGPSGKLWRDGRGASQNIIPASTGAAKAVGKVIPELNGKITGMAFRVPTPNVSVVDLTVRLEKPASYDAIKKVVKAAADGPMKGILGYTEQQVVSSDFNGDTHSSIFDAGAGIALNDHFVKLVTWYDNEFGYSNRVIDLMAHMATKE

SEQ ID NO: 1933 - protein, 363 aa, Salmo salar
MPHAFPFLTPDQKKELSDIAHKIVAQGKGILAADESTGSVAKRFQSINTENTEENRRLYRQLLFTADERAGPCIGGVIFFHETLYQKTDAGKTFPQHVKSRGWLVGIKVDKGVVPLAGTNGETTTQGLDGLYERCAQYKKDGCDFAKWRCVLKITSTTPSRLAIMENCNVLARYASICQMHGIVPIVEPEILPDGDHDLKRTQYVTEKVLAAMYKALSDHHVYLEGTLLKPNMVTAGHSCSHKYTHQDIAMATITALRRTVPPAVPGITFLSGGQSEEEASINLNVMNQCPLHRPWAITFSYGRALQASALKAWGGKPKNGKAAQEEFIKRALANSLACQGKYVSSGDSAAAGDSLFVANHAY

SEQ ID NO: 1934 - protein, 434 aa, Salmo salar
MSIIKIHAREILDSRGNPTVEVDLYTAKGRFRAAVPSGASTGIHEALELRDGDKSRYLGKGTLKAVDHVNKDIAAKLIEKKFSVVDQEKIDKFMLELDGTENKSKFGANAILGVSLAVCKAGAAEKGVPLFRHIADLAGHKDVILPCPAFNVINGGSHAGNKLAMQEFMILPIGASNFHEAMRIGAEVYHNLKNVIKAKYGKDATNVGDEGGFAPNILENNEALELLKSAIEKAGYPDKIIIGMDVAASEFYKAGKYDLDFKSPDDPARYITGDQLGDLYKSFIKGYPVQSIEDPFDQDDWAAWSKFTAAVDIQVVGDDLTVTNPKRIQQAVEKKACNCLLLKVNQIGSVTESIKACKLAQSNGWGVMVSHRSGETEDTFIADLVVGLCTGQIKTGAPCRSERLAKYNQLMRIEEALGDKAKFAGKDYRHPKVN

SEQ ID NO: 1935 - protein, 434 aa, Salmo salar
MSITKIHAREILDSRGNPTVEVDLYTAKGRFRAAVPSGASTGVHEALELRDGDKSRYLGKGTVKAVDHVNKDIAAKLIEKKFSVVDQEKIDHFMLELDGTENKSKFGANAILGVSLAVCKAGAAEKGVPLYRHIADLAGHKDVILPCPAFNVINGGSHAGNKLAMQEFMILPIGASNFHEAMRIGAEVYHNLKNVIKAKYGKDATNVGDEGGFAPNILENNEALELLKTAIEKAGYPDKIIIGMDVAASEFYKAGKYDLDFKSPDDPARYITGDQLGDLYKSFIKGYPVQSIEDPFDQDDWAAWTKFTAAVDIQVVGDDLTVTNPKRIQQAVEKKACNCLLLKVNQIGSVTESIKACKLAQSNGWGVMVSHRSGETEDTFIADLVVGLCTGQIKTGAPCRSERLAKYNQLMRIEEELGAKAKFAGKDYRHPKIN

SEQ ID NO: 1936 - protein, 377 aa, Salmo salar
MCDDDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETAYNSIMKCDIDIRKDLYANNVLSGGTTMYPGIADRMQKEITALAPSTMKIKIIAPPERKYSVWIGGSILASLSTFQAMWISKQEYDEAGPSIVHRKCF

SEQ ID NO: 1937 - protein, 381 aa, Salmo salar
MPFGNTHNNFKLNFKVEEEYPDLTKHNNHMAKVLTKDMYAKLRDKQTPSGFTLDDVIQTGVDNPGHPFIMTVGCVAGDEESYEIFKDLLDPIISDRHSGYKPTDKHKTDLNFENLKGGDDLDPNYVLSSRVRTGRSIKGYTLPPHNSRGERRAVEKLSVEALNTLDGEFKGKYYPLNKMTDAEQEQLIADHFLFDKPVSPLLLGAGMARDWPDARGIWHNDAKSFLVWVNEEDHLRVISMEKGGNMKEVFRRFCVGLKRIEETFKKHNHGFMWNEHLGYVLTCPSNLGTGLRGGVHVKLPKLSTHPKFEEILTRLRLQKRGTGGVDTASVGGVFDISNADRLGSSEVDQVQMVVDGVKLMVEMEKKLEKGEAIDGMIPAQK

SEQ ID NO: 1938 - protein, 247 aa, Salmo salar
MSRKFFVGGNWKMNGDKASLGELIKTLNSAKLDPNTEVVCGAPSIYLEFARSKLDPKIGVAAQNCYKVKGGAFTGEISPAMIKDVGVHWVILGHSERRWVFGETDELIGQKCAHALENGLGVIACIGEKLDEREAGITEKVINAQTKHFADNIKDWSKVVLAYEPVWAIGTGKTASPAQAQDVHDKLRQWVKANVSEAVANSVRIIYGGSVTGGTCKELGGMKDVDGFLVGGAALKPEFVDIINAKQ

SEQ ID NO: 1939 - protein, 380 aa, Salmo salar
MTKNCHNDYKMKFSDEEEFPDLSLHNNHMAKVLTKDMYKKLRSKSTPSGFTLDDCTQTGVDNPGHPFIMTVGCVAGDEECYEVFKDMFDPIISDRHGGYKPTDKHKTDLNFENLKGGDDLDPAYVLSSRVRTGRSIKGYTLPPHNSRGERRMVEKLSIEALATLDGEFKGKYYPLNGMTDAEQDQLIADHFLFDKPVSPLLLSAGMARDWPDARGIWHNDAKSFLVWVNEEDHLRVISMEKGGNMKEVFRRFCVGLQKIEAVFKKHNHGFMWNEHLGYVLTCPSNLGTGLRGGVHVKLPKLSTHAKFEEILTRLRLQKRGTGGVDTASVGGIFDISNADRLGSSEVQQVQMVVDGVKLMVEMEKKLEKGEAIDGMIPAQK

SEQ ID NO: 1940 - protein, 284 aa, Salmo salar
MDAIKKKMQMLKLDKENALDRAEGAEGDKKAAEDKSKQLEDDLVALQKKLKGTEDELDKYSESLKDAQEKLEVAEKTATDAEADVASLNRRIQLVEEELDRAQERLATALTKLEEAEKAADESERGMKVIENRASKDEEKMELQDIQLKEAKHIAEEADRKYEEVARKLVIIESDLERTEERAELSEGKCSELEEELKTVTNNLKSLEAQAEKYSQKEDKYEEEIKVLTDKLKEAETRAEFAERSVAKLEKTIDDLEDELYAQKLKYKAISEELDNALNDMTSI

SEQ ID NO: 1941 - protein, 530 aa, Salmo salar
MSKGKDMGSAFIQTQQLHAAMADTFLEHMCLLDIDSEPAVARNTGIICTIGPASRSVNMAKEMIKSGMNIARMNFSHGTHEYHAETIKNVREATESFGPGTIEYRPVAIALDTKGPEIRTGLIKGSGEAEVELKKGAHIKLTLDDKYKDNCDEKHLWLDYKNITKILKVGGHVYIDDGLMSLKVKEVGADFLDCEIENGGTLGSKKGVNLPGAAVDLPAVSEKDIQDLQFGVEQGVDMVFASFIRKAADVHAVRKVLGEKGKNIKIISKLENHEGVRRFDEILEASDGIMVARGDLGIEIPTEKVFIAQKMMTGRCNRIGKPITCATQMLESMIKKPRPTRAEGSDVANAVLDGNDCIMLSGETAKGDYPLEAVRTQHKIAREAEAAMYHRQMFEEIRRTSHLTRDPTESVAIGAVEASFKCCASAIIVLTKTGRSAHLLSRYRPRAPIIAVTRCGQTARQAHLYRGIYPVLYTKPANDVWAEDVDLRVNFALEMGKHRHFFKSGDVIIVVTGWRPGPGYTNTMRVVLVP

SEQ ID NO: 1942 - protein, 193 aa, Salmo salar
MAPKKDAKAPAKKAEPAKAAAPAPAPEPDVVAAPPPLDLSTVKVEFTPDQQEDYKEAFGLFDRVGDAKVAYNQVADIMRALGQNPTNKEVRKVLGNPSDEDMAAKRLEFEAFLPMLQHIVNDPNKGTFDDYVEGLRVFDKEGNGTVMGAELRIVLGTLGEKMSEAEIDALMQGQEDENGSINFEAFVKHIMSI

SEQ ID NO: 1943 - protein, 844 aa, Salmo salar
MSKPLSDHDRKKQISVRGLAGVENVAELKVAFNRHLHFTLVKDRNVASKRDYYFALANTVRDHLVGRWIRTQQYYYEKDPKRVYYISLEFYMGRTLQNTMVNLALENACDEAIYQLGLDMEELEDMEEDAGLGNGGLGRLAACFLDSMASLGLAAYGYGIRYEFGIFNQKIVNGWQVEEADDWLRYGNPWEKARPEYMRPVKFYGRTEHTPEGVKWVDTQVVLALPYDTPIPGYRNNIVNTMRLWSAKAPCDFNLKDFNVGGYIQAVLDRNLCENISRVLYPNDNFFEGKELRLKQEYFVVAATLQDIVRRFKASKFGSREIVRTDFAQLPNKVAIQLNDTHPAMAIPELMRVLVDEEKLEWDKAWDVCVRTCAYTNHTVLPEALERWPIDLFHHLLPRHLEIIYEINRRFLQYVASKFPGDNDRLRRMSLIEEGECKKVNMAHMCIVGSHAVNGVARIHSEILVATLFKDFYELDPHKFQNKTNGITPRRWLVMCNPGLAEVIAERIGEEFVRDLDQLKKLLKFIDDDAFIRDIAKVKQENKLKFAVHLEEHYKVKINPQSMFDFQVKRIHEYKRQLLNCLHMITYYNRIKKEPNKHWTPRTIMVGGKAAPGYHTAKMIIRLITAIGEVVNHDPVIGDRLKVIFLENYRVTLAEKAIPSADLSEQISTAGTEASGTGNMKFMLNGALTIGTMDGANVEMAEEAGEKNLFIFGMRVEEVDAMDAGKGYHASEYYNRIPELKQAMDQISGGFFSHKQPDLFKELVDLLMHHDRFKVFADYEAYIKSQDKVNELYKKPKEWTKMVIHNIAGCGKFSSDRTISQYAREIWGMEPSLEKIPAPDEQLK

SEQ ID NO: 1944 - protein, 417 aa, Salmo salar
MSLSNKLTLDKVDVKGKRVIMRVDFNVPMKDHNITNNQRIKAAVPTIKHCLDHGAKAVVLMSHLGRPDGNPMPDKFSLKPVAAELKSLLGKDVHFLKDCVGPEVEKACADPAAGSVILLENLRFHVAEEGKGKDASGNKTKATQEQIDSFRASLSKLGDVYVNDAFGTAHRAHSSMVGVNLSQKAAGFLMKKELDYFAMALEKPARPFLAILGGAKVKDKIQLINNMLDQVNEMIIGGGMAFTFLKVLNNMEIGNSLYDDEGAKIVKELMAKAEKNKVKINLPVDFITADKFDEHAQTGTATVAAGIPAGWMGLDCGPESNKHFAAAVGRAKQIVWNGPVGVFEFENFAKGTKSLMDKVVEVTKSGCVTIIGGGDTATCCAKWGTEDKVSHVSTGGGASLELLEGKVLPGVDALSSA

SEQ ID NO: 1945 - protein, 193 aa, Salmo salar
MAPKKDAKAPAKKAEPAKAAAPAPAPEPEVVAAPPPLDLSTVKVEFTPDQQEDYKEAFGLFDRVGDAKVAYNQVADIMRALGQNPTNKEVRKVLGNPSDEDMAGKRLEFEAFLPMLQHIVNDPNKGTFDDYVEGLRVFDKEGNGTVMGAELRIVLGTLGEKMSEAEIDALMQGQEDENGSINFEAFVKHIMSI

SEQ ID NO: 1946 - protein, 170 aa, Salmo salar
MAPKKAKRRGAAAEGGSSNVFSMFEQSQIQEYKEAFTIIDQNRDGIISKDDLRDVLASMGQLNVKNEELEAMVKEASGPINFTVFLTMFGEKLKGADPEDVIVSAFKVLDPEATGFIKKEFLQELLTTQCDRFSAEEMKNLWAAFPPDVAGNVDYKQICYVITHGEEKEE

SEQ ID NO: 1947 - protein, 255 aa, Salmo salar
MTTAHKLVIVRHGESEWNQYNKFCGWFDADLSEKGLEEAKRGAKAIKDAGMKFDICHTSVLKRAVKTLWTIMEGTDQMWLPVYRTWRLNERHYGGLTGLNKAETAEKHGEEQVKIWRRSFDTPPPPMEHDHAFHKIISESRRYKGLKPGELPTCESLKDTIARALPYWNDVIAPEIKAGKNVIIAAHGNSLRGIVKHLEGMSDAAIMELNLPTGIPIVYELDANLKPVKPMAFLGDAETVKKAMEAVAAQGKAKK

SEQ ID NO: 1948 - protein, 172 aa, Salmo salar
MSEKRMTSSRKHHLKSLMLQIAANLIEEEKKEMKQEKVNFMANIPALDLSGDQAMLMEMLKKLSQTIDKVDEERYDAEAKVKKTEKEIEDLKMKVIEVQGIKKPALKKVRMSADAMLAALLGTKHKASMDFRANLKEVKKEVKEEEEVGDWRKNVDEQAGMDGRKKKLSPHK

SEQ ID NO: 1949 - protein, 194 aa, Salmo salar
MADKIKDAKIIFVVGGPGSGKGTQCEKVVAKYGYTHLSSGDLLRAEVASGSERGKTLQAIMQKGELVPLDTVLDMIKDAMIAKADVSKGFLIDGYPREVKQGEEFEKKIGAPCLLLYIDAKGETMVKRLMKRGETSGRADDNEETIKKRLDLYYKATEPVIAFYSSRGIVRKIDSELPVDEVFGHVAKAIDDLK

SEQ ID NO: 1950 - protein, 506 aa, Salmo salar
MPAKPAPIKKAAPKEPAPKKEEAPAPAPAEAAPAEVAPPAEVEAPPAEAAPAEAAAPAEAAPTEEKAPAEPAPEQPKAPTPPPPDEPTSEPLEVTVDDKSDTSVTITWRPPKTIPANSGLDGYTVEITKEGTEDWKAANEDLTVSCRYVIKNQTTGDRLLIRVVAVNPGGRSPPATIADPVLVKEVGARPKVRLPRFLRQRYVKKVGEKINIVIPYSGKPKPVVSWLKDGQPLDSKRANIRTSDRDSILFIRQAERVDSGSYEMCVKVDDFEDKAAIIIQIIELPGPPASIKIVDVWGFNVALEWTVPKDNGNTEITGYTVQKADKKTGDWFNILEHYARLNATISDLIMGNTYTFRVFAENKCGLSEECAVTKGEATIVKEVIDYKPTPFVEHDFTEAPKFTTVLNDRSTTVGYSTKLLCSVRGCPKPKIMWMKNKMILNNMDNPKYRMISTGGICTLEIRKPGPYDGGEYVCRAENTLGKVDTGCKLEVRKPGQADADKDKKEQ

SEQ ID NO: 1951 - protein, 109 aa, Salmo salar
MACAHLCKEADIKTALEACKAADTFNFKTFFHTIGFASKSADDVKKAFKVIDQDASGFIEVEELKLFLQNFCPKARELTDAETKAFLKAGDADGDGMIGIDEFAVLVKQ

SEQ ID NO: 1952 - protein, 574 aa, Salmo salar
MLRLPTVMRQVRPVSRALAPHLTRAYAKDVKFGADARTMMLKGVDLLADAVAVTMGPKGRTVIIEQSWGSPKVTKDGVTVAKAIDLKCKYQNIGAKLVQDVANNTNEEAGDGTTTATVLARAIAKEGFDSISKGANPVEIRRGVMLAVETVINELKRMSKPVTTPEEIAQVATISANGDVEIGAIISNAMKKVGRKGVITVKDGKTLYDELEIIEGLKFDRGYISPYFINTAKGQKCEFQDAYVLLSEKKISSVQSIVPALELANQHRKPLVIVAEDVDGEALSTLVLNRLKVGLQVVAVKAPGFGDNRKAQLHDMAVATGGTVFGDEAVGIALEDIQAHDFGKVGEVSVTKDDTMLLKGKGDTAAIEKRQAEIVEQLENTTSDYEKEKLNERLAKLSDGVAVLKVGGTSDVEVNEKKDRVTDALNATRAAVEEGIVPGGGCALLRSIPALDALVPINTDQKIGIDIIRRALRVPAMTIAKNAGVEGSLVVEKILQAAGEIGYDAMEGEYVNMVEKGIIDPTKVVRTALMDAAGVASLLSTAECVVTELPKDEKEAGMPGGMGGMGGGMGGGMF

SEQ ID NO: 1953 - protein, 278 aa, Salmo salar
MSDTEEVEAIAEEVVEEVVEEEVVEEEVEVAPEAAPEPEAEPEPEPEPEAEPEPEPEPEPEAEAQKPQFKVPKIPDGDKVDFDDIQKKRQNKDLIELQALIDAHFEHRKKEEEELIALKERIEKRRAERAEQNRIRSEKEKERAARREEERLKREEADAKKKADEDAKKKSALSSMGSNYSSHLQKADSKRGGKKETEREKKKKILAGRRKALNIDHLNEEKLKEKAKELHEWMQTLESEKFDHIERLKRQKYEVTTLRKRVEELSKFSKKGKTVRRK

SEQ ID NO: 1954 - protein, 350 aa, Salmo salar
MALKKVCIIGSGNWGSAIAKIVGANAGKLDVFDTTVNMWVFEEMVNGRKLTEIINTDHENVKYLPGHKLPPNIVAVPEVTDAVKGADILIFVIPHQFINRICDTIKEHIKKDAVGMSLIKGVDEGPEGLKLISDVIREKLGVTMTVLMGANIANEVAEEKFCETTIGCKNKEWGPILKKLMQTTNFRVTVVEEADVVEICGALKNIVAVGAGFCDGLGFGDNTKAAVIRLGLMEMIAFARIFCTAGPVSPVTFLESCGVADLITTCYGGRNRKIAEAFAKTGKTIEELEKEMLNGQKLQGPATAAEVNHILKKKGLVDKFPLFSAVNQICFHGHPVKEFITCLQNHPEHM

SEQ ID NO: 1955 - protein, 462 aa, Salmo salar
MGKEKIHINIVVIGHVDSGKSTTTGHLIYKCGGIDKRTIEKFEKEAAEMGKGSFKYAWVLDKLKAERERGITIDISLWKFETAKYYVTIIDAPGHRDFIKNMITGTSQADCAVLIVAGGVGEFEAGISKNGQTREHALLAYTLGVKQLIVGVNKMDSTEPPYSQKRFEEIQKEVSTYIKKIGYNPATVAFVPISGWHGDNMLEASPNMGWFKGWKVERKEGGASGVTLLEALDSILAPSRPTDKPLRLPLQDVYKIGGIGTVPVGRVETGTLKAGMIVTFAPANVTTEVKSVEMHHETLEAALPGDNVGFNVKNVSVKDIRRGNVAGDSKNDPPMEAGNFTAQVIILNHPGQISQGYAPVLDCHTAHIACKFSELKEKIDRRSGKKLEDNPKALKSGDAAIIVMVPGKPMCVESFAAYPPLGRFAVRDMRQTVAVGVIKAVDKKAASTGKVTKSAIKATKAK

SEQ ID NO: 1956 - protein, 448 aa, Salmo salar
FESDLAAHQDRVEQIAAIAQELNELDYHDAVTINARCQGICDQWDNLGTLTQKRRDSLERVEKLWETIDQLYLEFAKRAAPFNNWMDGAMEDLQDMFIVHSIEEIQSLITAHDQFKATLPEADKERVATMGIQNEIVKIAQTYGIKLSGVNPYTNLSPQDITDKWDAVKHLVPLRDQMLQEEVARQQSNERLRRQFAAQANIIGPWIQTKMEEISHVSVDIAGSLEEQMSNLKQYEQNIINYKCNIDKLEGDHQLSQESLIFDNKHTNYTMEHVRVGWEQLLTTIARTINEVENQILTRDAKGISQEQLNEFRASFNHFDRKRNGMMDPDDFRACLISMGYDLGEVEFARIMTLVDSNNTGVVTFQAFIDFMTRETAETDTADQVMASFKILASDKTYITVEELRRELPPEQADYCISRMTSYIGSGAPPGALDYISFSSALYGESDL

SEQ ID NO: 1957 - protein, 298 aa, Salmo salar
MSDAVVSFIKDFLAGGIAAAISKTAVAPIERVKLLLQVQHASQQITKEMQYKGIMDCVRRIPKEQGFISFWRGNLANVIRYFPTQALNFAFKDKYKKIFLGGVDQKTQFWRWFAGNLASGGAAGATSLCFVYPLDFARTRLAADIGKSGAEREFSGLGSCLSKIYKADGIKGLYQGFNVSVQGIIIYRAAYFGVYDTAKGMLPDPKNTHIFVSWMIAQSVTAAAGIISYPFDTVRRRMMMQSGRKSADIMYTGTIDCWKKIAKNEGGKAFFKGAWSNVIRGMGGAFVLVLYDEIKKYT

SEQ ID NO: 1958 - protein, 451 aa, Salmo salar
MAGYLKVLSSLSRSAATFSKNPAVLAPATTCQSLQQRNYGDKRIKVSQPVVEMDGDEMTRIIWEFIKEKLILSNVDVELKYYDLGLPYRDQTDDQVTIDSAIATQKYHVAVKCATITPDEQRVEEFKLKKMWKSPNGTIRNILGGTVFREPIICKNIPRLVPGWTQPITIGRHAFGDQYRATDFVVSQPGTFKMVFSPTDGSKGQEWEVYKFPGGGCGMGMYNTDESISGFAHSCFQYAIGKKWPLYLSTKNTILKAYDGRFKDIFEEIYQANYKPEFDKLKIWYEHRLIDDMVAQVLKSDGAFVWACKNYDGDVQSDILAQGFGSLGLMTSVLVCPDGKTIEAEAAHGTVTRHYREHQKGNPTSTNPIASIFAWTRGLEHRGKLDGNPDLIKFALTLEKVCVETVESGVMTKDLAGCIHGLSKCKLNVHYVNTEDFLDAIKNNLDKALGK

SEQ ID NO: 1959 - protein, 417 aa, Salmo salar
MAFSFTRMMSCRNTATLLASLGAGTMATCYLMTDSNILSAEERRKLYPPSADFPDLRRHNNCMAHALTPAIYGKLRDQVTPNNWTLDQCIQTGVDNPGHPFIKTVGMVAGDEESYTVFADLFDPVIKDRHNGYDPKTMKHPTDLDASKITNGVFDEKYVLSSRVRTGRSIRGLSLPPCCSRSERREVERVTVQALAGLKGDLAGHYYSLGDMTEKEQQQLIDDHFLFDKPVSPLLTCAFMARDWPDGRGLWHNNEKTFLIWVNEEDHTRVISMEKGGNMKRVFERFCRGLQQVEKLIQERGWEFMWNEHLGYILTCPSNLGTGLRAGVHVRLAKLSKDPRFGKILDNMRLQKRGTGGVDTATTGDTFDISNNDRLGKSEVELVQLLVDGVNYLIDCEKRLERGQDIKVPAPIAQFRK

SEQ ID NO: 1960 - protein, 528 aa, Salmo salar
MLSVRVAAALARSLPRRAGFVSKNVAAACVGVNHLHTHKPCLAAKTGTAEVSSILEEKILGADTSADLEETGRVLSIGDGIARVYGLRNVQAEEMVEFSSGLKGMSLNLEPDNVGVVVFGNDKLIKEGDIVKRTGAIVDVPVGEELLGRVVDALGNAIDGKGPLGSSIRRRVGLKAPGIIPRISVKEPMQTGIKAVDSLVPIGRGQRELIIGDRQTGKTAIAIDTIINQKRFNEGKDEKKKLYCIYVAIGQKRSTVAQLVKRLTDADAMKYTIVVSATASDAAPLQYLAPYSGCSMGEFFRDNGKHGLIIYDDLSKQAVAYRQMSLLLRRPPGREAYPGDVFYLHSRLLERAAKMHDNFGGGSLTALPVIETQAGDVSAYIPTNVISITDGQIFLETELFYKGIRPAINVGLSVSRVGSAAQTKAMKQVAGTMKLELAQYREVAAFAQFGSDLDAATQQLLNRGVRLTELLKQGQYCPMAIEEQVTVIYAGVRGHLDKMDPSKITRFEKGLPCTHPQPAPGPAHHHQD

SEQ ID NO: 1961 - protein, 561 aa, Salmo salar
MTKITVVKTKAYPDQKPGTSGLRKRVTVFQTNAHYAENFIQSIISCIDPAERQPGLLVVGGDGRFFMKDAIQLIIQIAAANGIGHLVIGQDGIMSTPAVSCVIRKLKAVGGIILTASHNPGGPNGDFGIKYNIASGGPAPEGITDKIFQISKSITEYHICPDLKVDISKIGKQTFNVDTFKPMTVEIVDSVEAYAEMLRGIFDFHALKGLVSGSNHIKVRLDAMHGVVGPYVKKIVCEELGAAADGAFNCVPKEDFGGHHPDPNLTYASDLVNAMKGGEYDLGAAFDGDGDRNMVLGKHGFFVNPSDSVAVIAANITCIPYFQKTGVKGLARSMPTSGALDNVAKALKMNLYETPTGWKFFGNLMDAGKLSLCGEESFGTGSDHIREKDGLWAVLAWMSILAHRKQSVEEIMKDHWNKFGRNFFTRYDYEEVDSDKANTMIKELEAKMFDKSFVGQKFSSGDKSYEVPVSDNFAYTDPVDGSVSKNQGLRIVFSDGSRIIFRLSGTGSAGATVRLYIDSYEKDPAKIYGDAQVMLKPLVEIALKISGLHEKTGRTGPTVIT

SEQ ID NO: 1962 - protein, 914 aa, Arthrospira platensis C1
MSVKASGGSSVARPQLYKTVPVSTISQAEQQDRYLGKTELSDLATYFSSGAKRLEIAQVLTQNAELIVSRAANRIFTGGSPLAFLERPEEPEMAMAAAGSGDMEVAEGMKLGTISYVDNRGGGFFDGIKSLFKDSGSGPAVFLPPGFRPINVSRYGPGNMTKSLRDLSWFLRYTTYAIVAGDPNIIAVNVRGLREIIENACSSAATLVALQEMRRSALGYLQNDKEGQEIALQYFNVLISEFEGATPSNKVRQGQSVDQQGLELPQIYFNATIARQKFVMKPGLSSSEKQDVVKAAYRQVFERDITRAYSQGISDLESKFKNGEISTKEFIRRLGKSPLYRQQFYSRFVNSRVVELAARHFLGRGLSSPEEFSKYFAIVTKGGLAALVDAMVDSSEYADYFGEETVPYLRGLGTEAQECRNWGPQIDLFNYSAPFRTVPQFVTLFGDYKQPLRDQHVYGIGNDPLEIQFGAIFPKETRSPQNRPAPFGKDTRRILIRNGAGIDNQLSNPGARGNAPGSLGPKVFKLDQLPGGYVSSKFSNKGGSNGASVKFSESSTQKVIRAAYLQVFGRELYSGQRQTVAEIKLENGDITVREFIRILAKSDVFRNMYWTSLYVCKAIEYIHRRLLGRPTYGRQEMNSYFDLCSKKGFYALVDAIIDSVEYNEAFGEDTIPYERYLTPGGLSLRSMRVGTLAEKMTMVKDEPTPRFVELGTPTDQMKGELEIDNRINQGVNKRREQSKVFKLTNVTDKVALQTTIGAIYRQIFERDIDPYVTKKEFTALESKLGNGEITVKEFVEALGASALYIREFYTPYPNTKVIELGTKHFLGRAPLNQAEIRKYNQILASQGLKAFIGAMVNSMEYAQVFGEDTVPYRRFPTLPAANFPNTELLYNQLTKQNDELVVPSFEPVLANDRS

SEQ ID NO: 1963 - protein, 914 aa, Arthrospira platensis
  source: /note="str. Paraca"
MSVKASGGSSVARPQLYKTVPVSTISQAEQQDRYLGKTELSDLATYFSSGAKRLEIAQVLTQNAELIVSRAANRIFTGGSPLAFLERPEEPEMAMAAAGSGDMEVAEGMKLGTISYVDNRGGGFFDGIKSLFQDSGTGPAVFLPPGFRPINVSRYGPGNMTKSLRDLSWFLRYTTYAIVAGDPNIIAVNVRGLREIIENACSSAATLVALQEMRRSALGYLQNDKEGQEIALQYFNVLISEFEGATPSNKVRQGQSVDQQGLELPQIYFNAAEARQKFVMKSGMSSSEKLDVVKAAYRQVFERDITRAYSQGISDLESKFKNGEISTKEFIRRLGKSPLYRQQFYSRFVNSRVVELAARHFLGRGLSSPEEFSKYFAIVTKGGLAALVDAMVDSTEYADYFGEETVPYLRGLGTEAQECRNWGPQIDLFNYSAPFRKVPQFVTLFGDYKQPLRDQHVYGIGNDPLEIQFGAIFPKETRSPQNRPAPFGKDTRRILIHNGAGIDNQLSNPGARGNAPGSLGPKVFKLDQLPGGYISSKFSNKGGNSGASVKFSESSTQKVIRAAYLQVFGRELYSGQRQTVAEIKLENGDITVREFIRILAKSDVFRNMYWTSLYVCKAIEYIHRRLLGRPTYGRQEMNSYFDLCSKKGFYALVDAIIDSVEYNEAFGEDTIPYERYLTPGGLSLRSMRVGTLAEKMTMVKDEPTPRFVELGTPTDQMKGELEIDNQIKQGVNKRREQSKVFKLTNVTDKVALQTTIGAIYRQIFERDIDPYVTKKEFTALESKLGNGEITVKEFVEALGASALYIREFYTPYPNTKVIELGTKHFLGRAPLNQAEIRKYNQILASQGLKAFIGAMVNSMEYAQVFGEDTVPYRRFPTLPAANFPNTELLYNQLTKQNDELVVPSFEPVLANDRS

SEQ ID NO: 1964 - protein, 545 aa, Arthrospira platensis NIES-39
MAKRIIYNENARRALERGMDILAESVAVTLGPKGRNVVLEKKFGAPQIVNDGVTIAKEIELEDNIENTGVALIRQAASKTNDAAGDGTTTATVLAHAMVKEGLRNVAAGANPIELKRGIDKATAFLVDRIAEHARPVEDSKAIAQVGTISAGNDEEVGQMIAEAMDKVGKEGVISLEEGKSMTTELEITEGMRFDKGYISPYFATDTERMEAILDEPYILLTDKKITLVQDLVPVLEQVARSSRPLLIIAEDIEKEALATLVVNRLRGVLNVAAVKAPGFGDRRKAMLEDIAVLTGGQVITEDAGLKLESTKIDMLGKARRITITKDNTTIVAEGNEAGVKARCEQLRRQMEETESSYDKEKLQERLAKLAGGVAVIKVGAATETEMKDRKLRLEDAINATKAAVEEGIVPGGGTTLAHLAPQLEEWATSNQLTGEALTGAMIVARALLSPLKRIAENAGENGAVVAERVKEKSFDVGYNAANGEYVNMFEAGIVDPAKVTRSALQNAASIAGMVLTTECIVADKPEPKDNAAPAGAGMGGDFDY

SEQ ID NO: 1965 - protein, 1040 aa, Arthrospira platensis NIES-39
MNNVKVRIYELSRELNLENKDILAVCERLNISVKSHSSTITESDAERIEKYVASHPISTWSDENPDAAHQSHSGGGGGADKKKQQILEIRRPNLIRPENQPSPADSPQPEPSAESVATPPKPPNLSESSVSSQTNISELPKPNNSPQPPRKPPVEVTSSGATTAQDDVSGTIKPEKTTPQVSKSTTEEESPTLVAPPARPVPTATKSPQLSRKPVLKQNKPTPKPSQGGSAPVDKSADKADKADKPVASKQKKRPVPSDNQEVRDVKRRVSTVKPAKSMPELQPPPSRQSTVAIKTDSTDIIEDDSDIGAMPEDDGILESKRPKRGLTLKRPQPMTSPKRASAVDDEDDDDEKGGKAAKAKVKRPRIKPLIDDEDDEDFDSLTANSSESEALSMSLARPPKAKTGSGAGKLAVVSNQGRRKSAPSRNSGGSGGNSTAASRRSPTPALPEKVERLVVQGPMTVQELAHALLIAETEIIKRLFSRGIAVNITETLDFKTISMVCEELEVTVVTEEQKSEAQKPDNMLNAEDLDNLQRRPPVVTIMGHVDHGKTTLLDSIRKTKVAQGEAGGITQHIGAYHVDVTNESGETQQVVFLDTPGHEAFTAMRARGARVTDIAILVVAADDGVRPQTVEAISHAKAAGVPMVIAINKMDKESAQPDRVKQELTEYGLVPEEWGGDTIIVPVSAINGGNLDTLLEMLLLVAEVEDLYANPNRMAKGTVIEANLDKARGPVATLLVQNGTLRVGDVILAGSALGKVRAMIDDHGERVDNASPSFAVEVLGLRDVPAAGDEFEVFESEKEAAALASERANTARQSRLLQGRVSLSALSARVQEGELKDLNIILKADVQGSVEAIVNALKKLPQKEVQLRLLLAAAGEVTETDIDLAAASDAVLIGFNTTVASGARGAADRAGVDIREYNIIYNLLDDIEAAMEGMLEPELVEEPLGQAEVRAIFPVGRSRVAGCYVQSGKLIRNCKIRVHRGGQIVYDGFLDSLKRIKDDVKEVNAGYECGIAAENFNDWNESDSIEAYRMVTKRRTLSR

SEQ ID NO: 1966 - protein, 811 aa, Arthrospira platensis C1
MEKSADKADKADKPVASKHKKRPVTSDNQEVREVKKRVSTVKPARSMPELQPPPSRQPSVAIKTEPTEIIEDDSDIGAIPEDDGLLDSKRPKRGLTLKRPQPMTSPKRASSVDDDDDDIDEKGGKAGKAKVKRPRIKPLIDDEDDDDFDSLTTDSSESEALSISLARPPKAKTASGSGKLAAVSNQGRKKSAPSRHSGGSGGSGSGAAASRRAPTPALPEKVERLVVQGPMTVQELAHALSIAETEIIKRLFSRGIAVNITETLDFKTISMVCEELEVTVVTEEQKSAAQKPDNILNAEDLDNLQRRPPVVTIMGHVDHGKTTLLDSIRKTKVAQGEAGGITQHIGAYHVDVQNESGETQQVVFLDTPGHEAFTAMRARGARVTDIAILVVAADDGVRPQTVEAISHAKAAGVPMVIAINKMDKESAQPDRVKQELTEYGLVPEEWGGDTIMVPVSAINGGNLDTLLEMLLLVAEVEDLYANPNRMAKGTVIEANLDKARGPVATLLVQNGTLRVGDVILAGSALGKVRAMIDDHGQRVENASPSFAVEILGLRDVPAAGDEFEVFESEKEAAALASERANTARQSRLLQGRVSLSALSARVQEGELKDLNIILKADVQGSVEAIVNALKKLPQKEVQLRLLLAAPGEVTETDIDLAAASDAVLIGFNTTTASGARQAADRAGVDIREYNIIYNLLDDIEAAMEGMLEPELVEEPLGQAEVRAIFPVGRSRVAGCYVQSGKLIRNCKIRVHRGGQTVHDGFLDSLKRIKDDVKEVNAGYECGIAAENFNDWNEGDSIEAYRMVTKRRTLSR

SEQ ID NO: 1967 - protein, 836 aa, Arthrospira platensis C1
MVENKEKAFVLWFEEVGIVDVPLVGGKNASLGEMIQQLGSQGVSVPTGFATTAYAYRYFIEKAGLEVKLRELFSDLDVEDMPNLRQRGKQARALILDTPFPPELEEAIVSYYRKLCERYGTSAEFCEKFDSDYKEECKRYASDIDVAVRSSATAEDLPDASFAGQQETYLNVYGEDTVLKSCHKCFASIFTDRAISYRTIKGFDHFDVALSVGVQKMVRSDLASSGVMFSIDTETGFKNAALVTAAYGLGENVVQGAVNPDEYFVFKPTLKQGFRPILEKRLGTKELKMVYDIGGTKLTKNVSVPVSEREKFCITDDEILKLAEWAVIIENHYSTVRGCYTPMDIEWAKDGVTGELFIVQARPETVQSQKSGSVLRSYKLNGTSNVLSRGRAVGEMIGQGKARVIMDVHRIDDFQPGEVLVTNKTDPDWEPIMKRSSAIVTNAGGRTCHAAIIAREMGIPAIVGCGDATEVVKTGQDITVSCSEGEEGRVYEGLVPFDVNETVLDNLPKTRTQILMNVGNPEEAFGLASIPCDGVGLARLEFIIANHIKAHPLALLKYDQLEDESVKREIGELTKLYDHKPDFFVDKLAHGIGTIAAAFYPNPVIVRMSDFKSNEYANLLGGRQFEPKEENPMIGWRGASRYYDPNYREAYGLECVALKRVRDEMGLTNVVPMIPFCRTPDEGRKVLAEMEKYGLKRGENGLQVYVMCELPSNVIFADEFAQVFDGFSIGSNDLTQLTLGLDRDSALVAHIFDERNEAVRRMVTIAIKAAKKYGRKIGICGQAPSDYPEFARFLVELGIDSMSLNPDSVIKTILDIGKMEESGVLVDDIMEVAQAK

SEQ ID NO: 1968 - protein, 836 aa, Arthrospira platensis NIES-39
MVENKEKAFVLWFEEVGIADVPLVGGKNASLGEMIQQLNSKGVSVPTGFATTAYAYRYFVEKAGLEVKLRELFSDLDVEDMPNLRQRGKQARALILDTPFPPELEEEIVKYYRKLCERYATSAEFCEKFDSDYKEECKRYASDVDVAVRSSATAEDLPDASFAGQQETYLNVYGEDTVLKSCHKCFASIFTDRAISYRTIKGFDHFDVALSVGVQRMVRSDLASSGVMFSIDTETGFKNAALVTAAYGLGENVVQGAVNPDEYFVFKPTLKQGFRPILEKRLGTKELKMVYDIGGTKLTKNVSVPVSEREKFCITDDEILKLAEWAVIIENHYSTVRGCYTPMDIEWAKDGITGELFIVQARPETVQSQKSGSILRSYKLNGTSNVLSRGRAVGEMIGQGKARVIMDVHRIDDFQPGEVLVTNKTDPDWEPIMKRSSAIVTNAGGRTCHAAIIAREMGIPAIVGCGDATQAVKTGQEITVSCSEGEEGRVYEGLVPFDVNETVLDNLPKTRTKILMNVGNPEEAFGLASIPCDGVGLARLEFIIANHIKAHPLALLKYDQLEDESVKREIGELTKLYDHKPDFFVDKLAHGIGTIAAAFYPNPVIVRMSDFKSNEYANLLGGRQFEPKEENPMIGWRGASRYYDPNYREAYGLECVALKRVRDEMGLTNVVPMIPFCRTPDEGRKVLAEMEKYGLKRGENGLQVYVMCELPSNVIFADEFAQVFDGFSIGSNDLTQLTLGLDRDSALVAHIFDERNEAVRRMVTIAIKAAKKYNRKIGICGQAPSDYPEFARFLVELGIDSMSLNPDSVIKTILDIGKMEESGVLVDDIMEVAQAK

SEQ ID NO: 1969 - protein, 345 aa, Arthrospira platensis C1
MDNAIGLEIIEVVEQAAIASARWMGKGEKNTADHVAVEAMRQRMNQIHMRGRIVIGEGERDEAPMLYIGEEVGICTQENSATFCNPEELVEIDIAVDPCEGTNLVAYGQNGSMAVLAISEKGGLFAAPDFYMKKLAAPPVARGHVDLNKSATENLQIISDCMGRAVEELVVVVMDRPRHKELIKEIREAGARVRLISDGDVSAAISCAFSGTNIHALMGIGAAPEGVISAAAMRCLGGHFQGQLIYDPEVVKTGLIGESKESNIARLKDMGIENPDKVYNAEELANGRTVLFAACGITSGTLMEGVRFFGGGARTQSLVISSQSKTARFVDTIHMFEKPKNIQLR

SEQ ID NO: 1970 - protein, 359 aa, Arthrospira platensis C1
MAIVPMRLLLDHAAENDYGIPAYNVNNMEQIQSIMQAAHETNSPVILQASRGARSYAGENFLRHLILAAVETYPHIPVAMHQDHGNSPATCYSAMRHGFTSVMMDGSLEADAKTPSDFEYNVRVTAEVVNVAHSIGVSVEGELGCLGSLETGMGDKEDGHGAEGVLTRDQLLTDPDQAVEFVERTQVDALAVAIGTSHGAYKFSRKPTGEILAISRIEEIHRRLPNTHLVMHGSSSVPEDLIALINQYGGQIPETYGVPVEEIQKGIKSGVRKVNIDTDNRLAITAAIREAAAKDPSNFDPRHFMKPSIKYMQKVCADRYQQFGTAGNADKIKVQTLDEFAAKYASGALSATSKKAVAV

SEQ ID NO: 1971 - protein, 284 aa, Arthrospira platensis C1; identical to SEQ ID NO: 607

SEQ ID NO: 1972 - protein, 1597 aa, Arthrospira platensis C1
MQAKEILQKSVQFLQQQAEAYLQQGQVDDARKACEQLLKIQPTSAVGLKILGDVSLRGGDLEGAKQNYTKALELQPNWAEVYANLGSLYARSQQWEQAQAAYQKAISIKPEFAGAYRNLAKVWTQLNRPLDAIRTQYKAYTLEPHTVSAQEHLALGDGLMQQGMATEAQACYQNAINLNPNLAAAYQNLGEALKQQGKLQEAATYFRKAIELNNQTPAVSNPVDTLAAAVSTPQDTLAAATAARQVPQPDVLVVGQSAQAPIEKGMGVPISRPVNPETVLQEAKAFCAIKKWEQAVSACQKALRLDPNLAEAYKIQGNALQVLGEMEAAVRSYHKALEVKPQFPEVHANLGSLYAQEDRLEKAVTFYQQAIAQNPNFAGVYRNLAKVLERLGREGEASICLEKAYTLEPNKATPEDHVRLGNTRLAQGKLDQAYESYQRALELNKQLAPAYYGIGKVKAYGQAWSEAEAAYRQAIELDPKSGVFYQGLAECLAGKQDFDGAIALYGQLLQLNPNWAAGYYQIGELRNQQWNLSEAEAAYRKALELDKNLAAAYYGLGRVLLRQERWADVVPVLRQAMALDASGADFELCKGFADALVQTGQLDEAIAFYQKATDLAADNAEVWQKLGDIWRDKQAFDQAIEAYQKANQLDANLFWSHNGLADVLFKLERWSEAVEAYQKAIAIKSDYSWSYNSLAEALVKLERWSEAATAYREAARLNPEFPWSSYNLGEVSVRLQNWEEAVKGYRAAMAVQSDLPGIQQKLADALRERAKGDLDEALGCYLQVMEQEPDNVDTYHKAIEIKPDDSELYVKLADTLARQTQLDGAIVFYQMAQDLDPDNRAIASRLQQVIEKKNEGVDLFIPQETFGETPILPTQKKSHPSEQPILPTQKKSRPSEQRFPIDQESYEQWLRENLPRPADLRQMSQAVNYLGYKPLISVIMPVYNTPEKFLKKAIESVINQVYPYWELCIADDNSSEPWIKPLLEEYARKDNRIKVAFRTENGHICAASNSALELAIGEYIALLDHDDVITPEALYEVALVLNENPDADMIYSDEDKLDQYGQRVFPYFKPDWCPDSFLARMYTCHLGVYRRELVNQVGNFRIGYEGSQDYDLVLRVTEKTNKIFHIPKILYSWRQHSGSTAYDPNSKLYAYIAAEKALNESFARCREKAQIVSDHENFPGQYTVRYHIEEHKLVSIIIPTRNLGTTLNHCLQSIFEKSTYPNYEVVVIDNGSDEQETFDIINAWKQKEPQRFSCYEFDVPFNYPQINNYGVTKARGDYLLFLNNDTEVLTPDWIEAMVEQAQRSSIGAVGALLLYPDDTIQHAGVVLGIGGVAGHSHKGYQAHHLGYYNQLVTVNNYSAVTGACLMCRRETFEEVGGLDEELEVAFNDVDFCLKLVSRGYRNIYLPHVVLYHYESKSRGYEDTPEKEERFKRESKIMKQRWRDVLKNDPCYNPNLSRIRQDYGIRLSNDENQVVAISMSEDKEALLGCAIDSPKLHHPFNEENMLIQGWVIGKHSPAKLIKFICGDRVLGESKMNQERGDVAKVFPDVPHAIDSGFVKTLDVSETPSEVEILILATMEDGNEIPLSTLHLRHGSSDD

SEQ ID NO: 1973 - protein, 546 aa, Arthrospira platensis AGB-AP02
MAVKGHAAPPTPWSKNLAEPKIDPTAYVHSFSNIIGDVRIGAHVLVAPGTSIRADEGFPFYIGDESNIQDGVVIHGLDEGKVKGDDGQSYSVWIGKNSSITHLSLIHGPAYVGDNCFIGFRSTVFNARVGNGCIVMMHALIQDVEIPPGKYVPSGAIITNQQQADRLPSVTDTDIKFSTHVVGVNQALAAGYQCSENLACISPLRNETKGSSSNGGRARSGGHSNLGAGPIPPETVQTISQLLAQGYKIGTEHADARRFRTGSWRSCAPIDSRNTSEVVSALAACLQDHQGEYVRLLGIDSKAKRRVLEEIIQRPDGPVASKSSNGQVSNAAASTASPSRTTATGSSDLAQKVSQILNQGYKIGTEYADARRFRTGSWRSGPQIDSSSASAVLSQLDAFMNEHTGEYVRLIGIDQKAKRRAVEEIIQRPDGRVSATPSPSAASPAPSSRSAQSSYSSANSSLTSETIEQVKNLLAQGYKIGTEHADKRRFRTGSWRSCTPIDSNNQREVMAALEGCMQEHSGEYVRLIGIDAQAKRRVLEEIIQRP

SEQ ID NO: 1974 - protein, 338 aa, Arthrospira platensis C1
MMKVAINGFGRIGRNFLRCWLTRGENTNLEVTAINDTSDPRINAHLLKYDSMLGTLHDADIKADENSLIVNGKTIKCVSDRNPLNLPWSEWGIDLIIEATGVFVTEEGASKHLSAGAKRVLITAPGKGSNIGTYVVGVNDHNYDPNAHVIVSNASCTTNCLAPVVKVLQDNFGIIKGTMTTTHSYTGDQRLLDASHRDVRRARAAALNIVPTSTGAAQAVALVIPELKGKLNGIAMRVPTPNVSVVDFVAQVEKTTFTEEVNKALQEAAEGPMKGILAYSDLPLVSSDYRGNNASSIVDASLTMVMGGDLVKVVAWYDNEWGYSQRVVDLAEIVAKHS

SEQ ID NO: 1975 - protein, 337 aa, Arthrospira platensis NIES-39
MKVAINGFGRIGRNFLRCWLTRGENTNLEVTAINDTSDPKINAHLLKYDSMLGTLHDADIKADENSLIVNGKTIKCVSDRNPLNLPWSEWGIDLIIEATGVFVTEEGASKHLSAGAKRVLITAPGKGSNIGTYVVGVNDHNYDPNAHVIVSNASCTTNCLAPVVKVLQDNFGIIKGTMTTTHSYTGDQRLLDASHRDVRRARAAALNIVPTSTGAAQAVALVIPELKGKLNGIAMRVPTPNVSVVDFVAQVEKTTFTEEVNKALQEAAEGRMKGVLAYSDLPLVSSDYRGNNASSIVDASLTMVMGGDLVKVVAWYDNEWGYSQRVVDLAEIVAKHW

SEQ ID NO: 1976 - protein, 254 aa, Arthrospira platensis C1
MVPLPLLSYTTTSFNTRVAGYEVPGDEQPQIYTAENMPSGSEWDALIWAAYRQIFSEHQMLKSNRQTFLESQLKFGQITVRDFIGGLATSAPFLERNYQTNSNYRFAEMCVQRILGRDVYNEREKIAWSIVIANKGPKGFIEELLNSDEYLDNFGYDTVPYQRRRILPQRNMGETPFNLKTPRYNEYHRTQLGFPQVIWQTSVRRFVPQEKQPKAGDPANFLAMAKQVSRPANTVTRVALGSINFDTMVPYRQR

SEQ ID NO: 1977 - protein, 751 aa, Arthrospira platensis C1
MTISPPEREVKAKVTVDKDPTPTSFERWGKPGHFRRDLAKGPSTTTWIWNLHADAHDFDSHTSDLEDISRKIFSAHFGHLAVIFIWLSGAYFHGAKFSNYEAWLTNPTGIKPSAQVVWPIFGQEILNADVGGGFQGIQITSGLFQLWRASGITNEFQLYCTAIGALVMAGLMLFAGWFHYHKRAPKLEWFQNVESMMNHHLAGLLGLGCLGWAGHQIHVSLPINKLLDAGVAPKDIPLPHEFILNSSLMAELYPSFKQGLTPFFTLNWGVYADFLTFKGGLNPQTGGLWLSDTAHHHLALAVLFIIAGHMYRTNWGIGHSMKELLEAHKGPFTGEGHKGLYEILTTSWHAQLAINLAMLGSLSIIVAHHMYAMPPYPYIATDYPTQLSLFTHHMWIGAFCIVGAGAHAAIFMVRDYDPAKNVNNLLDRVIRHRDAIISHLNWVCIFLGFHSFGLYVHNDTMRAFGRPQDMFSDTGIQLQPIFAQWVQNLHTLAPGNTAPNALASVSPAFGGDVIAVGGKVAMMPIALGTADFMVHHIHAFTIHVTVLILLKGVLYSRSSRLIPDKSELGFRFPCDGPGRGGTCQVSGWDHVFLGLFWMYNSLSIVIFHFSWKMQSDVWGTVASDGTISHITNGNFAQSAITINGWLRDFLWAQASQVINSYGSALSAYGLMFLAAHFVWAFSLMFLFSGRGYWQELIESIVWAHNKLKVAPAIQPRALSIIQGRAVGVAHYLLGGIVTTWAFFLARIISVG

SEQ ID NO: 1978 - protein, 823 aa, Arthrospira platensis C1
MFERFTEKAIKVIMLAQEEARRLGHNFVGTEQILLGLIGEGTGVAAKVLKSMGVNLKDARIEVEKIIGRGSGFVAVEIPFTPRAKRVLELSLEEARQLGHNYIGTEHLLLGLIREGEGVAARVLENLGVDLSKVRTQVIRMLGETAEVTAGGSSGRTKTPTLDEFGSNLTQMAAEGKLDPVVGRQKEIERVIQILGRRTKNNPVLIGEPGVGKTAIAEGLAQRIAQNDIPDILEDKRVVTLDIGLLVAGTKYRGEFEERLKKIMDEIRSCGNVILVIDEVHTLIGAGAAEGAIDAANILKPALARGELQCIGATTLDEYRKHIERDAALERRFQPVMVGEPSVPETIEILYGLRERYEQHHKLKIIDEALEAAAKLSDRYISDRYLPDKAIDLIDEAGSRVRLINSQLPPAAKELDKELRQVLKEKDDAVRSQDFDRAGELRDREMEIKSQIRAIAQNKKSETRTDDDDSPMVTEEDIAQIVASWTGIPVNKLTESESEKLLHMEDTLHQRLIGQEEAVKAVSRAIRRARVGLKNPNRPIASFIFSGPTGVGKTELTKSLAAYFFGSEEAMIRLDMSEFMERHTVSKLIGSPPGYVGYNEGGQLTEAVRRRPYTVVLFDEIEKAHPDVFNMLLQILEDGRLTDAKGRTVDFKNTLIIMTSNIGSKVIEKGGGGLGFEFEENQADAQYNRIRNLVNEELKQYFRPEFLNRLDEIIVFRQLNKDEVKEIAVIMLNEVFGRLTEKGIRLEITDRFKERLVEEGYNPSYGARPLRRAIMRLLEDSLAEEILSGRVKEGDTAIVDVNEDGQVQVLQGEKRELLPQAAD

SEQ ID NO: 1979 - protein, 811 aa, Arthrospira platensis C1
MATVYVNPSTGNDQGDGSQSSPYKTLTAACAKVESGTFIQLETGTYNSATGEQFPIMIPSGVTVVGNESGTGSGILIEGSGRHSSPSTGGQEVTIVMATNAELRGVTVTNNQVRGTGVWVESTSPNIVHCTFTRCRREGIYATGNGYPNILSNAFVENEGYGLSLEGNVQGEVRNNSFQNTGYGISVKGEVQTRISDNTLFENRSGLLIAGNSRPILRRNLIERNTGDGVVITNNAAPDLGSASESGGNMIRNNGGFDINHAGSVAIASFGNLLSAGRVQGNINVVAQSAPTSSPTTIHVNGSTGNDSAAGTASAPFKTITRGLQQATAGTVVQVAPGTYTAATGETFPLYVISGVTLIGNESSQGNGTQITGSGRFASPSAAGQNVTIVMENNSTLRGVSVTNEEIRGTAVWIESVYCVVANCRFFNSKREGVFVTGTAIPQILTSHFEKNAGNGIALAGNAKGEIRGNKLQDTGFAIAVQASAAPLISDNHIYNNRTGLVLSGSSKPVLRKNLIENNLQDGLTVIADAFPDLGSPQDAGGNIFRNNGKYDVQNAGKFTLVSVGNQINPTNTKGNIDFSANVTPSPSPSPSPSPSPSPSPSPSPSPSPSPTPTPTPPPGSDRFSDITGHWAREFIVRLTDMNIISGFPDGTFRPNENLTRAQHAALLAKAFDMAPIQQATAFRDVAIDFWGKMAIEQANRAGFLAGFPDRTFRPNENLNRAQAVVSLINGLKLTGGNPNSLNGYTDRGQIPSYATDAIATATERRIIVNYPTRTTLAPQRDITRAEISAILYQTLVATGRAEAINSPYIV

SEQ ID NO: 1980 - protein, 1143 aa, Arthrospira platensis C1
MPRGGDISILNGGDDVVGVTLISPNPNIPADLEHPSRPVQTMTNTTQYESAFELPDLIEIQRSSFRWFLETGLIEELESFSPISDYTGKLELHFLARDYKLKQPKYDVDDAKRRDSTYSVQMYVPTRLINKETGEIKEQEVFIGDLPLMTERGTFIINGAERVIVNQIVRSPGVYYKSEIDKNQRRTYSASLIPNRGAWLKFETDKNDLVWVRIDKTRKLSAQILLKALGLTNNEIFDALRHPDYFQKTIEKEGEFSEEDALMELYRKLRPGEPPTITGGEQLLQNRFFDPKRYDLGRVGRHKLNRKLRLSVPDSTRVLTPTDILSAIDYLINLEYDIGETDDIDHLGNRRVRSVGELLQNQIRVGLNRLERIIRERMTVGDAETLTPASLVNPKPLVAAIKEFFGSSQLSQFMDQTNPLAELTHKRRLSALGPGGLTRERAGFAVRDIHPSHYGRICPIETPEGPNAGLIGSLATHARVNPYGFIETPYYPVENGRVRRDLSPVYMTADEEDDLRVAPGDISYDSEGYILGDLVPVRYRQDFTKTSPDQVDYVAVSPVQIVSVATSLIPFLEHDDANRALMGSNMQRQAVPLLRPERPFVGTGLEAQAARDSGMVIVSRTDGEVSYVDGAKIRVIDPEGWEIEYELQKYQRSNQDTCLNQRPLVYEGDQVVAGQVLADGSSTEGAELALGHNVLVAYMPWEGYNYEDAILISERLVYDDVYTSIHIEKFEIEARQTKLGPEEITREIPNVGEDSLRQLDASGIIRIGAWVESGDILVGKVTPKGESDQPPEEKLLRAIFGEKARDVRDNSLRVPNGEKGRVVDVRVFTREQGDELPPGANMVVRVYVAQKRKIQVGDKMAGRHGNKGIVSRILPIEDMPYLPDGRPMDIVLNPLGVPSRMNVGQIFECLMGWAGENLKRRFKVIPFDEMFGQEMSRETVHSKLKEAREKLKKDWLFSEEYPGKTIVYDGRTGEAFDQPVTVGIAYILKLVHLVDDKIHARSTGPYSLVTQQPLGGKAQQGGQRFGEMEVWALEAFGAAYTLQELLTVKSDDMAGRNEALNAIVKGKAIPRPGTPESFKVLMRELQSLCLDIAAHKVETNKKDGASKDLEVDLMADEPHRVRTPSKPTYDLSVIDDDDQGNRL

SEQ ID NO: 1981 - protein, 409 aa, Arthrospira platensis C1
MARAKFERNKPHVNIGTIGHVDHGKTTLTAAITMTLAASGGAKARKYDDIDAAPEEKQRGITINTAHVEYETEQRHYAHVDCPGHADYVKNMITGAAQMDGAILVVSAADGPMPQTREHILLAKQVGVPSIVVFLNKADMVDDEELLELVELEVRELLSSYDFPGDDIPIVSGSALKALDFLTENPKTTRGENDWVDKIHALMDEVDAYIPTPERDIDKPFLMAVEDVFSITGRGTVSTGRIERGKVKVGDTVELIGIKDTRTTTVTGAEMFQKTLEEGMAGDNVGLLLRGIQKNDVQRGMVIAKPKSITPHTKFEAEVYILKKEEGGRHTPFFKGYRPQFYVRTTDVTGTIDEFTADDGSTPEMVIPGDRINMTVQLICPIAIEQGMRFAIREGGRTVGAGVVAKILA

SEQ ID NO: 1982 - protein, 401 aa, Arthrospira platensis NIES-39
MYSPTGTGVAMRTGAAGRIFVFEVEGMRQGQNTDNFNYPIRRSGTVYLTVPYERMNQEMRRLSKMGAKIVNIYPAGETPPVRTQAAPENGQQSQSSGTQTPTMTQAKAKTDIPVNIYKPKNPYIGKCLSNEELVREGGTGTVRHLIFDISGGDLRYLEGQSIGIIPPGTDNNGKPHKLRLYSIASTRHGDHVDDKTVSLCVRQLEYKHPETGETVYGVCSTYLCNLEAGADVAITGPVGKEMLLPEDEDATIIMMATGTGIAPFRAFLWRIFKEQHEDYKFKGLAWLFFGIPYSPNILYQQELEELQQQFPENFRLTLAISREQQNPEGGKMYIQDRIKENADQLWELIQKPNTHTYICGLKGMEGGIDEGMSAAAGKFDVDWSDYQKQLKKKHRWHVETY

SEQ ID NO: 1983 - protein, 409 aa, Arthrospira platensis NIES-39
MARAKFERNKPHVNIGTIGHVDHGKTTLTAAITMTLAASGGAKARKYDDIDAAPEEKQRGITINTAHVEYETAQRHYAHVDCPGHADYVKNMITGAAQMDGAILVVSAADGPMPQTREHILLAKQVGVPSIVVFLNKADMVDDEELLELVELEVRELLSSYDFPGDDIPIVSGSALKALDFLTENPKTARGENDWVDKIHALMDEVDAYIPTPERAIDKPFLMAVEDVFSITGRGTVSTGRIERGKVKVGETVELIGIKDTRTTTVTGAEMFQKTLEEGMAGDNVGLLLRGIQKNDVQRGMVIAKPGSITPHTKFEAEVYILKKEEGGRHTPFFKGYRPQFYVRTTDVTGTIDEFTADDGSTPEMIIPGDRINMTVQLICPIAIEQGMRFAIREGGRTVGAGVVAKILA

SEQ ID NO: 1984 - protein, 669 aa, Arthrospira platensis C1
MAVATQSLEQLCINSIRFLAIDAVEKANSGHPGLPMGAAPMAFVLWDRFMRYNPKNPKWFNRDRFVLSAGHGCMLHYALLHLTGYDSVGIDDIKQFRQWGSKTPGHPENHVTEGVEVTTGPLGQGIANAVGLALAEAHLAARFNKPDCTVVDHYTYVILGDGCNMEGISGEACSLAGHWGLGKLIAFYDDNHISIDGSTDISFTEDVAKRFEAYGWHVQHVADGNTDLEAIATAIEKAKAVTDQPSLIKVTTTIGFGSPNKANSHDVHGAALGKAEVQATRDHLGWSYPEFVIPDDAIKHFRKAVERGANYEDEWKAALETYKSKYPEEAATLERLLSGKLPEGWEKSLPTYTPETKADATRNQSGVTLNAIAGVLPELVGGSADLAPSNKTLLKGLGDFQKGQYQNRNLRFGVREHAMGAICNGIALHRSGLIPYGATFLVFTDYMRNSIRLSALSEAPVLWVMTHDSIALGEDGPTHQPVEHIASLRLIPDLTVIRPADGNETSGAYKVAIENRHYPTLMAFSRQNLPNLEGSSIDNVAKGAYVLSDNSDGTPDIILIGTGGETYLCVDAAVKLREEGKKVRVVSMPSWELFEKQDAAYKESVFPASVKKRLAVEAGVSFGWCRYVTDEGATISIDTFGASAPGGVVLEKFGFTVDNVVAKAKELLG

SEQ ID NO: 1985 - protein, 138 aa, Arthrospira platensis C1
MPKTTAEKLPEEPMTGKTLLHKVKSLGPNYSRRETAKQCGYYTRTKDNQTRANMTEFYDALLAAKGIALDPGRSKDGRGREASYRACVHKNGSLVIGANYTQEMGLKPGDQFEIRLGSKHIHLIQVEPKGMVDEDDEE

SEQ ID NO: 1986 - protein, 558 aa, Arthrospira platensis C1
MAKIVAFDEESRRAIERGVNALADAVRVTLGPRGRNVLIEKKFGVPDIVSDGITVAKAIELGDPLENTGARLIQEVAAKTNDVAGDGTTTAAVLAQAMIQEGLKNVAAGANPVALRRGIDKTVQYLVKEIESLAKPVEGSAIEQVATVSAGNDKEVGEMIALAMDKVTKDGVITVEESKSLTTELEVVEGMQIDRGYISPYFITDSERMTVELDNARVLITDKKISAIQDIVSVLEKVARSGQPLLIIAEDIDGEALATLVVNKARGVLNVAAIKAPGFGERRKAMLQDIAILTGGQLISEEIGLNLETATVEMLGTATKVTINKDSTTIVSGSGHQGEIQQRVEQLRKQLAETDSEYDQEKLQERIAKLAGGVAVIKVGAATETELKSRKLRIEDALNATKAAVDEGIVPGGGTTLIHLVKKVEQLAATFSIEEEKLGAKIVARALEAPLRQIANNSGVEGSVIVEQVRNSDSNIGYNALTGNFEDLIVAGILDPAKVVRSSLQNAGSIAGMVITTEVLVVEKPEPKPAMPDMDGMGGMGGMGGMGGMGGMGGMGMM

SEQ ID NO: 1987 - protein, 2340 aa, Arthrospira platensis C1
MYLTKDKLQHISTITHEGKVVVFGTDTEGKVFYTVKQDGFEDSYLNTPADQRTGWETWQPLEFPNEVDDQSVIEQEKAELTYQNDPSRYLLRSRYSTQGMTAVAPVQAIAALDHIYVFRQSTNNTLLVDRFVLDGMANKLNRKLEVRFKRSRQKHIPTKTMAMGNNGLSNVDTLDFRDANGNFFYEPTTELCLVSNLHKGWFSVVVVPTIENDVHRWHIFAYNSQTKKVELTTLRASQEGLFDLKDYTIYEEAEGSLVPKKIPGIIQRTLDIDGVSITNGLSATKYDLQQEQETQAGDTQLLRSATKLMVAIPTDKGVAALSFAIAGDGTLSEIDETPERTIARSRQREILLPLNTLDEVKALADQTPPPLGVIRGLALGTDADDAEDLVMVSTEGEAGQLANGDLVKISGTPDLRGLYGAQKIDDRTFEITLPTPADNLGYWEKEDLEEAGLIFDGMIAAYEKTADGKLRVTCDYHGLEDGDEVQIIGTDSYDNTYPVQTVDDNHFVIERRWAKGEAVNIKVVSRKRRGIVLDGVNDYIEIADPFGKNKNFTLSVWIKPTQINTGATQAVMGNDLWKPSLWIAPDNGGLHYMAFGDPSQESVLSGTFDNFFDQAETWVHVAWVKDGNRFRFYKNGVEFAVVEDVPEKLYSDPSSNYQFGKVGQDFFSGHLAEVRIWSLPQSADTIKNNMYLQLRGKEVGLEGYWRLGGLAEGKVSDFSIHGNEGTVYGDPYVSAATLSRKLASGADAVKYSNSDLFAVSQRATYEESFEFKVNAAKPVTLADLNNADGRGQGTKIFTFSHWGKTSRSANDTIAVSAVQDEFEDLGNGWYRASCTLTIPDEISLLRSFEIAKVQGNWNALEIRKHRIRLLSDAITTAKYTDDVALATLANDQATLTTNLQNLKRKEIQEARLKNEKQELEEKLAGLKNLELIRRQVNELTIEVQSLELQEQDCKLNYDHEVNNPFNYLCHIQTTYNGWFWHYHGGSVPRVGMYSSSSGNSTWKFTKVGQECYTIQNTYNGWFCHYHGGSVPMVGMYSSSSGNSTWKFTKVGQECYTIQNTYDDWFCHYHGGSVPMVGMYSSSSGNSTWKLIRTEEQVNNEIEKARQTWEEIVQLLKQKRALLHTSRKLLSAGDREKEAWEKRLAEVISLLTKLQTEINTLNADFLKSIEDSQVKPQTMPDITKDSNDLVTQGALLGFVQPASRLHTLETCEGNVQLSYFDNQGRMRQTNYDATADSRNAAFEQWIPDAHRACLNFNVSNSVLTLKAALPLPMDWSMEAWFVYPLPETQEWNTLTCANPKGYHILVRHGKQLGIYLGDMISGQYFFDCGFNLDTLSPGWHHLTAVGKGATTLFYIDGKKVGDTKAKALADAEEDLRKTPNDAAAKQKLEAIKAAMLKVSEPVYTIGNFLEGGQLFGKLSEVRIWSGVLSEEEIAINSKTLLSGNEPGLLAYYPMSEATGVEVRDHSGNGNNGTVSGTSWWASTVPIGNPGHTVMQFDGVNDHITLPEMNINYSKGFSVEVWVCHKSFTHWSGIIDFGNGSGADNILLANSHGTNNLVLAVYTNYYHEIQVENALTLGEWTHLAATIDASGNAKVYKDGQLLRSGICHLPNSINRTRNYIGRSNWDQDGYLDAQVSDLRIWNVARTQDEIQAGMNTRLGGKEPNLVAYYPLNEIKMEGNTRKVQDLAGNRHGTVHEALTTADNTLPIGGDALVSAEYSTVTLDPTTKRKAAIMRRFLGAPTINGATLLPDKRIETLELKWIGNAQFAPTLLGYIEGPPPVPSENLTIEEDYNGATSVELTMSEDVDFSWNRAQDSGLGAAAEIFAGAETEAAAGLGFTTRVATMRAGFKGNFDFSYQFLNESNITSSSSLSLTDRLELRGTPEVKPHFPHLGTRFIPKNIGYALVVSAISDVFVTRLARSGKMVGYQVRPVEGLPPDVNTITFLMNPAYTMNGSLDGMTGSSATSDRFFKHVPEMRSQYGSLYPASYYRLKEAYDLKEQIEAEDKRRESYFSNFNARLLDEASLDRNIDSGPAPSTIGVHREEDQPSTEMTEEEKKAADAAKLQNLQANANANVDKQSQATQAKQAEIQSKITDQEKQVQATESFAGWQKRMEDLQIRAAKRNIVNTYVWDADGGLRSEQQSFANTVEHTIGGSFTMNAALGAEAKFGAMATAELTAQATVNLTQTMTKTEARSKGFELSVDLSGLEYKGITDYNDRPILPGEKVDRYRFMSFYLEGSTDHFQDFFNYVVDPEWLRSNDEEARALRQTQAGKPNKAWWVLHRVTYVERPALMGFGRDVRKLRVAAEVSENQALLDKIAKLEDKNQKLEEKLDTILGLLKEQK

SEQ ID NO: 1988 - protein, 697 aa, Spirulina platensis
MARTIPLERVRNIGIAAHIDAGKTTTTERILFYSGVVHKMGEVHEGTAVTDWMAQERERGITITAAAISTSWLDHRINIIDTPGHVDFTIEVERSMRVLDGVIAVFCSVGGVQPQSETVWRQAERYQVPRIAFINKMDRTGADFFKVYGQIRDRLRANAVPIQVPVGRESDFHGLVDLVAMKTYLYTNDLGTDIQVSDEIPEEVQDLVAEYREKLLEAVAETDEALMEKYLEQLEGGEALTEEEIRHSLRQGTIKGLIVPVICGSSFKNRGVQRLLDAVVDYLPAPTEVPPIKGVLPDGEEGVRYADDDAPLSALAFKVMADPYGRLTFVRVYSGVLQKGSYIYNATKNKKERISRLIVLKSDERIEVEELRAGDLGAALGLKDTLTGDTICDEANSIILESLYIPEPVISVAVEPKTKQDMEKLSKALQSLSEEDPTFRVSIDSETNQTVIAGMGELHLEILVDRMLREFKVEANIGAPQVAYRETIRKSIRTEGKFIRQSGGKGQYGHVVIELEPGEPGSGFEFVSKIVGGSVPKEYINPAEQGMKEACESGVIAGYPLIDVKATLVDGSYHEVDSSEMAFKIAGSMAIKNGVTKASPVLLEPMMKVEVEVPEDFIGNVIGDLNSRRGQIEGQETDQSQSIAKVVAKVPLATMFGYATDIRSKTQGRGVFSMEFSHYEEVPRSVAETIIAKSKGN

SEQ ID NO: 1989 - protein, 1361 aa, Arthrospira platensis C1
MSDNKKIFRNRVIDKGQLKKLMTWAFMNHGSAVTAQVADELKDLGFKYATRAGVSISVDDLQIPQSKKDLLEEAEEEIRRTERRYTKGEITEVERFQKVIDTWNGTSEALKDEVVRNFRSTNPLNSVYMMAFSGARGNISQVRQLVGMRGLMADPQGEIIDQPIKTNFREGLTVTEYIISSYGARKGLVDTALRTADSGYLTRRLVDVSQDVILREIDCGTERGITLGDMTDGDRILIPLKDRLMGRVLGEDVKNPETGEIISFGEIRAVRNQVVCDDLASAICNAGVKKVFVRSPLTCEANRSVCRHCYGWSLAHAEMVDLGEAIGIIAAQSIGEPGTQLTMRTFHTGGVFTAEAAGFLRAPFDGTVKFPKTLRLRAFRTRHGDDSFLAESNGYLTVEGKDGNKRINISQGSTVVVHDGQAVNADQVLVEIMAGGRTARKTTEKATKDVATDLAGEVKFADVVPEEKLDRQGNMTRIAQRGGLLWVLAGEVYNLPPGAEPVVKNGDRVEPGSVLAQTKLQTEHGGIVRITDDNDIDPATVATETLADGMITTSSGEENALPREIEIITASVLLDQALVRLQSELGREQYVIETNSNHRFSLKVTPGSKVENHEVIAELMDDSYRTTTGGIIKYAGVEVAKRSKGKQGYEVTSGGTLLWIPEECHEVNKDISLLIVEDGQYVEAGTEVVKDIFCQSKGVIEVTQKNDILREIVVKPGELHLVDDPEMVMAIDGQIKNAGEEVIPGVTATELNYVEYVESPEGPALLLRPVVEFHVPETPPVPSQESLNQSISLQAVQRLSYKDGERVRSVEGVELLRTQLVINIGTEAPQLAADIELIPDEDNPEIMRLQLVILESLVIRRDIIADSTQGSTRTRLLVHDGQEIEPGAVVTRTEILGKDGGVVGGIRSGAEILRRCLIVRDTDMMTIQLPDGVTPTVKVGQLVVEDSEIAPGVKLSQSGQVVAINQDDSETSIVLRIGRPYRVSSGAVLHLSDGDLVQRGDNLVLLVFERPKTGDIIQGLPRIEELLEARKPKEACILAKQPGTAQLEVFDDLVQLRVIESGGAATEYPLTPGQTVIVSDGQTVDVGQPLTDGPANPHEILEVFFNYYLEQDGMVYEAALKSFQKCQIFLVNEVQSVYQSQGIDISDKHIEVIVRQMTSKVRIDDGGDTTTLPGELTELRQVEQVNEAMFITGGAPARYTPVLLGITKASLNTDSFISAASFQETTRVLTEAAIEGKSDWLRGLKENVIIGRLIPAGSGFNAYEDPVLAEESVMDEEPYSYLEDDVNNDDLREDVILDDHSARAYSDQAMFSDDLVDNEDDEDNEFAINDDSDNFPLIDDDDEEPFSSAIITDDILDDDDF

SEQ ID NO: 1990 - protein, 174 aa, Arthrospira platensis NIES-39
MVIEKVPDVVFKTRVRDESVGGPNPFRWQDRTTQEIFGGKRVVVFSLPGAFTPTCSSTHLPRYEELYDEIKAQGIDEIVCVSVNDAFVMFQWGKQQGADKVFLLPDGNGEFTRKMGMLVDKSNLGFGMRSWRYSMVVNDGKIEKIFVEPDFGDNCPTDPFEVSDADTMLAYLKG

SEQ ID NO: 1991 - protein, 271 aa, Arthrospira platensis Sp-1
MVGLAEASRLGIRAFEESERVELRPNFTEGDVQAVIWAAYRQVMGNEHLMQRERLTSAESLLRQGEITVRDFVRALAVSELYRKKFFYGNSQVRFIELNYKHLLGRAPYDESEIAFHVDLYNEEGYEAEINSYLDSPEYLESFGENVVPYYRGFATQRGQWTVGFNRMFQLYRGYANSDRAQNQTQGRLTWEVARNTSSPISPAGSGQALVGANGGSRGQLYRVVVVQKPTQLTPRMRKATAEYTVAYEQLSGQLQRINRMGGRVISVTPA

SEQ ID NO: 1992 - protein, 319 aa, Arthrospira platensis C1
MPFTIDSARSIFPETLAADVVPATIARFKQLSAEDQLALIWFAYLEMGKTITIAAPGAANMQFAEKTLEEIRQMTPLQQTQAMCDLANRTDTPICRTYASWSPNIKLGFWYELGRFMDQGLVAPIPEGYKLSANANAILVTIQGIDPGQQITVLRNCVVDMGFDTSKLGSYQRVAEPVVPPQEMSQRTKVQIEGVTNSTVLQYMDNLNANDFDNLISLFAEDGALQPPFQKPIVGRDNVLRFFREECQNLKLIPERGVSEPTEDGYTQIKVTGKVQTPWFGGNVGMNIAWRFLLNPENKVFFVAIDLLASPKELLNLVR

SEQ ID NO: 1993 - protein, 468 aa, Arthrospira platensis C1
MAVFDPSDPVLNPMWRQGMFVMPFMARLGVTQSWGGWSVTGEVADNPGLWSFEGVAATHIILSGLLFLAAVWHWVYWDLELFTDPRTGEPALDLPKMFGIHLFLSGLLCFGFGAFHLTGLFGPGMWVSDPYGLTGSIQPVAPSWGPEGFNPFNAGGIAAHHIAAGIVGIIAGLFHLSVRPPQRLYKALRMGNIETVLSSSIAAVFFAAFVVAGTMWYGSAATPIELFGPTRYQWDQGYFQQEIQRRVQASIAQGDSPSEAWSKIPEKLAFYDYVGNSPAKGGLFRVGPMNKGDGIAQGWFGHPVFTDAEGRELTVRRLPNFFETFPVILTDADGVIRADIPFRRAESRYSFEQTGVTVSFYGGELNGKTFTDPASVKKYARFAQQGEPFAFDRETLGSDGVFRTSTRGWFTFGHACFALLFFFGHIWHGSRTIFRDVFAGVEADLEEQVEWGNFQKVGDQTTRVQKTV

SEQ ID NO: 1994 - protein, 505 aa, Arthrospira platensis C1
MVSIRPDEIANIIRDQIEQYGQDVKVSNVGTVLQVGDGIARIYGLDKAMAGELLEFTDGTVGIALNLEEDNVGAVLMGEGLEIQEGSAVTATGRIAQVPVGEAMLGRVIDSLGRPIDGKGDIQASDTRLLESPAPGIIERRSVCEPMQTGITAIDSMIPIGRGQRELIIGDRQTGKTAIAIDTIINQKEEDVICVYVAIGQKASTVAQVVSTLEEKGALPYTIVVAANASDPATLQYLAPYTGAAMAEYFMYQGKATLVIYDDLSKQAQAYRQMSLLLRRPPGREAYPGDVFYLHSRLLERAAKLNDELGGGSMTALPIIETQAGDVSAYIPTNVISITDGQIFLSADLFNSGLRPAVNAGISVSRVGSAAQTKAMKKVAGKVKLELAQFAELAAFSQFASDLDQATRNQLERGKRLQELLKQPQNSPLQLFEQVAVIYSGINGYLDDVPEDKVVAFTTGLRDYLKNSKPKYGEIVQSQKVLTEEAEAMLKEAISEFKQTFLVSA

SEQ ID NO: 1995 - protein, 558 aa, Arthrospira platensis NIES-39
MAKIVAFDEESRRAIERGVNALVDAVRVTLGPRGRNVLIEKKFGVPDIISDGITVAKAIELGDPLENTGARLIQEVAAKTNDVAGDGTTTAAVLAQAMIQEGLKNVAAGANPVALRRGIDKTIQYLVKEIESLAKPVEGSAIEQVATVSAGNDKEVGEMIALAMDKVTKDGVITVEESKSLTTELEVVEGMQIDRGYISPYFITDNERMIVELDNTRVLITDKKISAIQDIVSVLEKVARSGQPLLIIAEDIDGEALATLVVNKARGVLNVAGIKAPGFGERRKAMLQDIAILTGGQLISEEIGLNLETATIEMLGTATKVTINKDSTTIVSGSGHKGEIQQRVEQLRKQLAETDSEYDKEKLQERIAKLAGGVAVIKVGAATETELKSRKLRIEDALNATKAAVEEGIVPGGGTTLIHLVKKVEQLASTFTIEEEKLGAKIVARALEAPLRQIANNAGVEGSVIVEQVRNSDSNIGYNALTGKFEDLIVAGILDPAKVVRSSLQNAGSIAGMVITTEVLVVEKPEPKPAMPDMDGMGGMGGMGGMGGMGGMGGMGMM

SEQ ID NO: 1996 - protein, 637 aa, Arthrospira platensis C1
MTVAQAVFPIDLGAYQYLKLDPANSTLTDEQRKALKANIELVRDAIVFFTATGAARGVGGHTGGPYDTAPEVMILDALFRGSPDKFVPIFFDEAGHRVATQYLMSVLEGSMPAEQLLSYRAAHSKLPGHPELGLTPGVKFSSGRLGHMWPYVNGVAMANPNKTLFCLGSDGSQQEGNDAEAARLAVSQQLNVKLIIDDNDVTIAGHPSDYIPGYTVAQTLIGHGLKVLEGDGEDIDSLYGLICQAINTDGPVAVINRRKMCVGIEGLEGSPHGHDVISVKGAIAYLEAKGRTEAVKYLQGIQAPKQNYTFIGSSDDLGSNRNVFGDAVVSVLATMTDSDRQEKVLCVDSDLEGSCGLQKIRTAYPEIFIKGGIMERGNFSAAAGFGMEKGKQGIFGTFSAFLEMCISEITMARLNYSNVLCHFSHSGIDDMADNTCHFGINNMFADNGLDDGYETRLYFPADANQMKACVEAVFFDPGLRFIFSTRSKVPYILNSDGNHFFGHGYKFIPGKDEVIREGTAGYIVSFGDSLYRSLDAVDRLKQEGIDVGLINKSTLNVVDEDMLAKIGNAPFVMVVEAFNRRTGLGSRFGSWLLERGYTPKYAYLATHKEGCGGLWEQFPHQGIDPNGIMTKVKELVR

SEQ ID NO: 1997 - protein, 2343 aa, Arthrospira platensis
  source: /note="str. Paraca"
MYLKQDKLQHISTITHEGKVVVFGTDSSGKIFYTVKQDGFEDSYLNTPADQRTGWETWQTLEFPNEADDQSVIEQEKAELTYQNDPSRYLLRSRYSTQGMTAVAPVQVIAALDHLYVFRQSTSNTLLVDRFVLDGMTNKLNRKLEVRFKRSRQKHTPTKTMTMGSNGLSNVDTLDFRDANGNLFYEPTTELCLVNNLHKGWFSVVVVPTIENDVHRWHIFAYNSQSEKVELTTLRASKEGLFDLKDYTIYEEVEETLVPKKIPGVIQRTLDIDGVSITNGLSATKYDLQQEQETQSGDTQLLRSATKLMVAIPTDKGAAALSFAIAGDGTLSEIDETPERTIARSRQREILLPLNTLDEVKALADSTPPPQGVIRGLALGTDADDAEDLVKVSTEGDAGELTNGDLVKIMGTQDLGGLYGAQKIDDHTFEIELPNAADNLGYWEKEDLEEAGLIFDGMIAAYEKTADGKLRVTCDYHGLENGDEVQIIGTENYDNTYPVQPVDDNHFVIERRWAKAEAVNIKVISRKRRGIVLDGVNDYIEIANPFAKNKNFTISAWIKPMQINTGATQAVMGNDLWQPSLWITPDNGGLHYMAFAAPNQESVLSGTFNNFFDQAETWVHIAWVKDDNRFKFYKNGVEFAVVENVPEKLYSDPSSNYQFGKVGQDFFSGHLAEVRIWSLPQSAETIKNNMYLQLRGKEVGLEGYWRLGGIAEGKVSDFAIHGNEGTVYGDPYVSAATLSRKLASGANAVKYSNSDLFAVSQRATYEESFEFKVNASKPVTLADLNNADGRGQDTKLFTFSHWGKTSRSANDTIAVSAVQDEFEDLGNGWYRASCTLTIPDEISLLRSFEIAKVQGNWNSLEIRKHHIRLLSDSITSAKYVDDMALKMLADDQADSMANLKDLKRKEMQEITLKNEKQELEEKLAGLKDLELIRRRVNELIVEIQDLEIQEKNCKSNYDYEVNNPFNYVCHIQTTYNGWFCHYDYSGSFPTIRMYPSSSGAGGKWKFNKISQEYYTIQTTYNGWFCHYDYSGSFPTVRMYSSSSGAGGKWQLNKVDQKYHTIQTTYNGWFWNYDYSGSFPTTRMKPSSSNPWQLVKTEEQVNDEIEKSRQAWQKITELLKQKRDLLYVSRQILSAGDQEKEAWEKRLDQVISLLTQLQIEINTLNTDFLKFISNSHVKPQVMPEVAKDDNDLVTQGALLGFLQPASRLHALETCEGNVQLSYFDTQGRMRQTNYDATADSRNAAFEQWVPDAYRACLNFNLSKSVLTLNTALPLPMDWSMEAWFVYPLPEKLEWNTLSRSDSEHHVLVKDGKQLGIYLRDGIQEQRFFDCGFNLDQLSPGWHHLTAVAKGDTTLFYIDGQKVGDTKAKALADAQESLTKTPNDSAAQQKVEAIKKAILKVVGVIRTIGNAPGGQPFGKLSEVRIWGDALSEEEININSKTLLSGNEPGLLAYYPMSEATGVEVRDHSGNSNNGTISSASWWASTVPIGNLGNTVMQFDGVNDHITLPEMNINYSEGFSLEVWVCHKSLKSWSRIIDFGNGSGADNILLANSAKTNTLVFAVNRGSSVQERIEVADILIPGEWTHLAATIDASGNAKVYKDGQLLRSGTCHLPNSINRKNNYIGRSNWSVDEYLDAQVSDLRIWNVARTQKDIQADMNTRLGGKEPNLVAYYPLNEVKLEGNTRKVQDLAGNRHGTVHEALTTQDNTLPIGGDALVSAEYSTVTLEPATKRKVAIMRRFLGAPTTNGATLLPDKRIETLELKWIGNAQFAPTLLGYIEGPPPVPSENLTIEEDYNGATSVELTMSEDVDFSWNRAQDSGLGAAAEIFAGAETEASAGLFVSARIATMRAGFKGNFDFSYQFLNESNITSSSSLSLTDKLELRGTPEVTPHFPHLGTRFIPKNIGYALVVSAISDVFVTRLARSGKMVGYQVRPVEGLPPDVNTITFLMNPAYTMNGSLDGMTGSSATSDRFFKHVPEMRSQYGSLYPASYYRLKEAYDLKEQIEAEDKRRESYFSNFNVRLLDETSLNRNIDSGPAPSTIGVNREEDKPATEMTEEEKKAADAAKQQNLQANANANVDKQSQATQAKQAEIQSKITDQEKRVQATESFAGWQRRMEDLQIRAAKRNIVNTYVWDADGGLRSEQQSFANTVEHTIGGSFTMNAALGAEAKFGAMATAELTAQATVNLTQTMTKTEARSKGFELTVDLGGLEYKGITDYNDQPILPGEKVDRYRFMSFYLEGSTDHFQDFFNYVVDPEWLRSNDEEARALRQTQAGKPNKAWRVLHRVTYVERPALMGFGRDVRKLRVAAEVSENQALLDKIAKLEDKNQKLEEKLDTILGLLKEQK

SEQ ID NO: 1998 - protein, 509 aa, Arthrospira platensis NIES-39
MGLPWYRVHTVVLNDPGRLISVHLMHTALVAGWAGSMALYELAVFDPSDPVLNPMWRQGMFVMPFMARLGVTQSWGGWSLTGEVADNPGIWSFEGVAATHIILSGLLFLAAVWHWVYWDLELFTDPRTGEPALDLPKMFGIHLFLSGLLCFGFGAFHLTGLFGPGMWVSDPYGLTGSIQPVAPSWGPEGFNPFNAGGIAAHHIAAGIVGIIAGLFHLSVRPPQRLYKALRMGNIETVLSSSIAAVFFAAFVVAGTMWYGSAATPIELFGPTRYQWDQGYFQQEIQRRVQSSIAQGDSPSEAWSKIPEKLAFYDYVGNSPAKGGLFRVGPMNKGDGIAQGWLGHPVFTDAEGRELTVRRLPNFFETFPVILTDADGVIRADIPFRRAESRYSFEQTGVTVSLYGGELNGKTFTDPASVKKYARFAQQGEPFAFDRETLGSDGVFRTSTRGWFTFGHACFALLFFFGHIWHGSRTIFRDVFAGVEADLEEQVEWGNFQKVGDQTTRVQKTV

SEQ ID NO: 1999 - protein, 138 aa, Arthrospira platensis NIES-39
MAKTTAEKLPEEPMTGKTLLQKVKSLGPSYSRRETAKQCGYYTRTKDNQTRANMTEFYDALLAAKGIALDPGRSKDGRGREASYRACVHKNGSLVIGANYTQEMGLKPGDQFEIRLGSKHIHLIQVEPKGMVDEDDEE

SEQ ID NO: 2000 - protein, 142 aa, Arthrospira platensis NIES-39
MVETLTGKAPKFGGSTGGLLTKAQVEEKYAITWTSTKEQVFEMPTGGAAIMNEGENLLYLARKEQCLALGTQLRTKFKPKIEDFKIYRIFPNGEMEYLHPKDGVFPEKVNEGREFNGKIDRKIGDNPNPASVKFSGKATYES

SEQ ID NO: 2001 - protein, 161 aa, Arthrospira platensis
MSIVTKSIVNADAEARYLSPGELDRIKSFVTSGERRVRIAETMTGARERIIKEAGNQLFQKRPDVVSPGGNAYGEEMTATCLRDLDYYLRLITYGIVAGDVTPIEEIGVVGVREMYKSLGTPIEAVAEGVRAMKSVATSLLSGEDAAEAGAYFDYLIGAMS

SEQ ID NO: 2002 - protein, 288 aa, Arthrospira platensis Sp-1
MAITTQASRLGTTAFQESSLVELRPNWSRDNAQEVIRAVYRQLLGNDYLMSSERLTSAESLLCDGSITVRELVRCVAKSELYKKKFFYPNFQTRVIELNYKHLLGRAPYDESEVVFHLDLYQNEGYDADIDSYIDSPEYLESFGENIVPYYRGFETQRGQKTVGFTRMFRLYRGYANSDSAQGEGTMSRLAQELGANRASVVVAPSGDSDGWSYRPSGQSVAPSTGFSQGGVLQAGRTYRVEVSGIRERRYPRVRRCSKAFIVPYDQLSAQLREIQRQGGTIASITPI

SEQ ID NO: 2003 - protein, 485 aa, Arthrospira platensis NIES-39
MVSTAEKTKIGYITQVIGPVVDIKFPDGKLPEIYNALKISGKNEAGQEISVVCEVQQLLGDNQVRSVAMSGTDGLVRGMEATDTGRAIQVPVGSGTLGRIFNVVGEPIDNLGPVPNDETSSIHRPAPAFVDLETSPSVFETGIKVVDLLAPYRRGGKIGLFGGAGVGKTVIIMELINNIAKAHGGVSVFGGVGERTREGNDLYNEMIESGVINKEDLPQSKVALVYGQMNEPPGARMRVALSALTMAEYFRDVSKQDVLLFIDNIFRFVQAGSEVSALLGRMPSAVGYQPTLGTEMGELQERITSTKEGSITSIQAVYVPADDLTDPAPATTFAHLDATTVLSRALASKGIYPAVDPLDSSSTMLQPSVVGEEHYQTARAVQSTLQRYKELQDIIAILGLDELSEEDRLVVARARKIERFLSQPFFVAEVFTGSPGQYVPLEKTIKGFQMILNGELDHLPEQAFYLVGDIDMAIAKGEKMKAENK

SEQ ID NO: 2004 - protein, 637 aa, Arthrospira platensis C1
MGKVVGIDLGTTNSCVAVMEGGKPTVIANAEGLRTTPSVVAYAKNGDQLVGQIAKRQAVMNPDNTFYSVKRFIGRKQEEVSNESTEVSYKVLRDSSGNVKLDCPARDRQFAPEEISAQVLRKLVEDASTYLGETVTEAVITVPAYFNDSQRQATKDAGKIAGVEVKRIINEPTAASLAYGMDKKSNETILVFDLGGGTFDVSILEVGDGVFEVLATSGDTHLGGDDFDKKIVDYLAGEFMKAEGVDLRKDKQALQRLTEASEKAKQELSSVTQAEINLPFITATSDGPKHLDMTLTRAKFEEICSDLIDRCRIPVENAIRDAKLDKSAINEVVMVGGSTRIPAVKELVKRVLGKEPNQTVNPDEVVAVGAAIQAGVLAGEVKDILLLDVTPLSLGVETLGGVMTKIIPRNTTIPTKKSEVFSTAVDGQTNVEIHVLQGEREMSNDNKSLGTFRLDGIPPAPRGVPQIEVTFDIDANGILNVTAKDKGTGKEQSISITGASTLPDTEVERMVKEAEKNAATDRERRERIDRKNQADTLAYQAEKQISELGDKVPADDKSKIEAMIKDLRDAIAQENDDQIKTLTTDLQQALYTLSSNLYQQAGGAAPGAEGPGPGAGPTDGDGGGSDDVIDADFTEAK

SEQ ID NO: 2005 - protein, 637 aa, Arthrospira platensis NIES-39
MTVAQAVFPIDLGAYQYLKLDPAHSTLTDEQRKALKANIELVRDAIVFFTATGAARGVGGHTGGPYDTAPEVMILDALFRGSPDKFVPIFFDEAGHRVATQYLMSVLEGSMPAEQLLSYRAAHSQLPGHPELGLTPGVKFSSGRLGHMWPYVNGVAMANPNKTVFCLGSDGSQQEGNDAEAARLAVSQQLNVKLIIDDNDVTIAGHPSDYIPGYTVAQTLIGHGLKVLEGDGEDIDSLYGLICQAINTDGPVALINHRKMCVGIEGLEGSPHGHDVISVKAAIAYLEAKGRTEAVKYLQGIQAPKQNYTFIGSSDDLGSNRNVFGDAVVSVLATMTDSDRQEKVVCVDSDLEGSCGLQKIRTAYPEIFIKGGIMERGNFSAAAGFGMEKGKQGIFGTFSAFLEMCISEITMARLNYSNVLCHFSHSGIDDMADNTCHFGINNMFADNGLDDGYETRLYFPADANQMKACVEAVFFDPGLRFIFSTRSKVPYILNSDGNNFFGDSYKFIPGKDEVIREGTAGYIVSFGDSLYRSLDAVERLKQEGIDVGLINKSTLNVVDEDMLAKIGKAPFVMVVEAFNRRTGLGSRFGSWLLERGYTPKYAYLATHKEGCGGLWEQFPHQGIDPNGIMAKVKELVG

SEQ ID NO: 2006 - protein, 741 aa, Arthrospira platensis NIES-39
MATKFPKFSQDLAQDPTTRRIWYGIATAHDFETHDGMTEENLYQKIFASHFGHIAIIFLWTSGSLFHVAWQGNFEQWIKDPLNVRPIAHAIWDPQFGQPAVDAFTQAGASNPVDIAYSGVYHWWYTIGMRTNGDLYQGSIFLLLLAAVFLFAGWLHLQPKYRPSLSWFKNAESRLNHHLAGLFGVSSLAWTGHLVHVAIPESRGQHVGWDNFLSTLPHPAGLAPFFTGNWGVYAQNPDTVRHVFGTSEGSGTAILTFLGGFHPQTESLWLTDMAHHHLAIAVIFIIAGHMYRTNFGIGHSIKEMCDAKDFFGRRLEGPFNMPHQGIYETYNNSLHFQLGWHLACLGVITSLVAQHMYSIPPYAFIAKDYTTMAALYTHHQYIAGFLMVGAFAHGAIFLVRDYDPEQNKGNVLARVLDHKEAIISHLSWVSLFLGFHTLGIYVHNDVVVAFGTPEKQILIEPVFAQFIQAAHGKAVYAMDVLLSNPESIATTAWPNYGNVWLPGWLDAINSGTNSLFLTIGPGDFLVHHAIALGLHTTTLILVKGALDARGSKLMPDKKDFGYAFPCDGPGRGGTCDISAWDSFYLAMFWMLNTLGWLTFYWHWKHLGIWQGNVAQFNESSTYLMGWFRDYLWLNSSQLINGYNPFGTNNLSVWAWMFLFGHLVWATGFMFLISWRGYWQELIETIVWAHERTPLANLVRWKDKPVALSIVQARVVGLAHFTVGYILTYAAFLIASTAGKFG

SEQ ID NO: 2007 - protein, 813 aa, Arthrospira platensis NIES-39
MKLNLSQIFLDHKVKPRGIIYVGAGEGRSLKRFAKFTNAQILLIEANPVTCERLKMAVGDRPNIQTVHMAIADQNSEATLHVTNIESNSSILPLTQYKKLYPNLSETQQIPVDTRTIDTILAELNLLPEDFNILYLDIQGAELLALTGASEILQHLDAIYTTTSQHQLFERGATLEQVNAFLNEHYFTPIAQATPYHPSRYEVVYIHNNLINTSILTPEIAANIRLHPPAEPKPTELKITLSRLQELESEQELLKYQLQQHQKDLGKSQSDYQQKHKELENSQSQLQQTRKDLEKSQSDFQQKQKELENSQSQLQQTRVECKNLHSQLEQSQEELEESKGIRDQILADLEKSYSQFKQSQTQLEQSQSQLERTQTELQQSQYQRDQILAELEQYHTRLQQTRKDLEKSQSDFQQKQKELENSQSQLQQTRKDLEKSQSDFQQKQKELENSQSQLQQTQKDLEKSQSDFQQKQKELENSQSQLQQTQKDLEKSQSDFQQKQKELESSQSQLQQTQKDLEKSQSDFQQKQKELENSQSQLQQTQKDLEKSQSDFQQKQKELENSQSQLQQTQKDLEKSQSDFQQKQKELENSQSQLQQTQKDLEKSQSDFQQKQKELENSQSQLQQTRKDLEKSQSDFQQKQKELENSQSEGKKLETKVKEVQDQLKNAQNKQTETQQELDKSRSELHDTREELEMANFQLDEVQVELEQATFELHKTKEELEGSQSQLQQQQKELEESQSQLQQQQKELEESKSEVQKLREQIQQIQQIQQYQNMSPPGQPVQQYQPAVAQSGNTYNAALVKMFAKIIAETMPD

SEQ ID NO: 2008 - protein, 161 aa, Arthrospira platensis; identical to SEQ ID NO: 521

SEQ ID NO: 2009 - protein, 460 aa, Arthrospira platensis C1
MVTLSSNSYLGGRDQESTGFAWWSGNARLINLSGKLLGAHVAHAGLIVFWAGAMALFEVSHFVPEKPMYEQGLILLPHLATQGWGVGPGGEVINTFPYFVVGVLHLISSAVLGLGGIYHAVRGPEVLEEYSSFFGYDWKDKNQMTNIIGYHLILLGCGALLLVFKAMFFGGVYDTWAPGGGDVRIINNPTLNPLVIFGYLLKAPFGGEGWIIGVDNMEDIIGGHIWIGLICIAGGVWHILTKPFGWARRAFIWSGEAYLSYSLGALSLMAFIASAFVWFNNTAYPSEFYGPTNAEASQAQSFVFLVRDQKLGANIGSAQGPTGLGKYLMRSPTGEIIFGGETMRFWDFKGPWLEPLRGPNGLDLNKLKNDIQPWQVRRAAEYMTHAPNGSINSVGGIITEAQGFNYVNPRAWLAASHFILAFFFLVGHLWHAGRARAAVAGFEKGIDRETEPVLAMPDLD

SEQ ID NO: 2010 - protein, 854 aa, Arthrospira platensis C1
MYQTGKGEFMTQPLIPIDQCPIQIEDDRTGTNVETLKRAFADNLFYLQGKYESLATQDDFYMALAYTLRDRLLSRWLKTMKTYMEKDVKVVYYLSAEFLMGRHMGNSLINLHLYDRVRQAVEESGLDLDEILEHEPDPGLGNGGLGRLAACFVDSLATLEIPAVGYGIRYEFGIFTQAIRDGWQAEVPDKWLRFGNPWEIAHPDQAVEVKLGGHTEMYHNEKGEYKVRWIPANRVVGIPYDTPVPGYDTNTVNPLRLWRAEASDDFNFDAFNAGNYDGAVAEKMRSETISKVLYPNDNTPQGKQLRLEQQFFFVSCSLQDIIRTHLLRHPSLHNLHDTAAIQLNDTHPAVAIAEMMRLLMDEHEMDWNTAWRVTQKTFSYTNHTLLPEALEKWSVGLFEYLLPRHLEIIYEINRRFLEDVKRWYPGDDNLISRLSLIDESGEKYVRMANLACVGSHAVNGVAALHTQLLKQDTLRDFYRLWPGKFINKTNGVTPRRWILMCNPKLAELYNSKIGEGWLKDLSQLKQLEKYVDDPDFCQQWREIKLHNKRQLAQYIWEHNGIEVDPHSMFDIQVKRIHEYKRQHLNLLHIIALYNQIKQNPDQHIVPCTFIFGGKAAPGYFMAKLIIKLTNSVADVINHDPDVRGRLKIVFLNNFNVSLGQRIYPAADLSEQVSTAGKEASGTGNMKFAMNGAMTIGTLDGANIEIREEAGEENFFLFGLTAQEVADTKAKGYNPRDYYSSNPSLKAVIDRIAAGYFSHGDKELFKPLVDSLMYHDQYMLFADYQAYVDCHKQVSKTYSDQDKWTRMSILNALRMAKFSSDRTIREYCNEIWNVQPVPIEMEEYSQENAGLNLGK

SEQ ID NO: 2011 - protein, 1567 aa, Arthrospira platensis C1
MDRKETNFNPHQPPTLKVRRLSNQGNSLGTPYAGPRWLVEERDACGVGFIADLNGKANHSIIEKALKALGCLEHRGGCSADYDSGDGAGVMTTIPWKILQAEGYGVSPEGDYGVGMVFLPQAGSSENSDPNHQVSDGEGKQQLARDTIAKVLESENLNLIGWRVVPVRPEVLGPMAAANQPCIEQLIVSSKKGLVGDDLERQLYLARRQCGVALEKEGLVWGQDIYICSWSCRTIVYKGMVRSAVLGEFYRDLQNPDYESQFAVYHRRFSTNTMPRWPLAQPMRLLGHNGEINTLLGNINWMRAREGILSHPVWGDRLWDLKPFVDANNSDSANLDNVMELLVRTGREPSESLMIMVPEAYQNQPLLKDYPEITDFYEFHSGVQEPWDGPALLVFSDGKQVGACLDRNGLRPARYCITKGGLIIVGSEAGVVQVEESEILEKGRLGPGQTIAVNLEESEILKNWDIKRKVAAKCNYGEWLRKYRYDLEPQPFVGTENPLLPDLAIQKAFGYGSEDVEMVIADMASLGKEPTFCMGDDIPLAVISEQPHLLYDYFKQRFAQVTNPAIDPLRERIVMSLQMRLGERGNLLDPKPEDARMLKISSPVLNEAELQKLADSGLKAVTLSTLYPVATGPDGLRLAVEALCEKAIAAVAQGAKILILSDRNSESQSPLNGENTYIPPLLAVGAVHHHLIESGDRLKCSLVVNTAQCWSTHHFACLIGYGASAVCPYLALATVRQWWSEPKTQMAMEKGKMPPLSMVQAQENYRAAVEGGLLKILSKMGISLLSSYQGAQIFEAIGIGEDLLNLGFKGTTSRIGGLTVAELAMEVSQFHAKAFPEMQGKKLENYGFVNYFKRGEYHGNSPELAKLLHQAVRGEGADHYTTYQAYLKDSPVAALRDLLDFQSDRSPISIDEVEPITDIVKRFCTGGMSLGALSPEAHETLAIAMNRLGGKSNSGEGGEDPARFKPLSDVGDDGISPSRPYLRGLKNGDSCSSAIKQVASGRFGVTPEYLMNAQSIEIKVAQGAKPGEGGQLPGKKVSPYIAMLRRSKPGVTLISPPPHHDIYSIEDLAQLIFDLHQINPNAQVSVKLVAEIGIGTIAAGVAKANADYIQISGHDGGTGASPLSSIKHAGTPWELGLTEVHRVLMENQLRDRVRLRVDGGLKSGWDVVMGALMGAEEFGFGTIAMISEGCIMARICHTNGCPVGVTTQREELRKRFPGTPDHVVNFFHFVASEVRELLAMLGYRSLTDLMGRSDLLKMRDLPLAKTKGLDLGVLMQPPVAPGNDWLNHEPVHSNGPVLDDSILADQEISDAISHQYKVAKTLDIVNTDRTVGARIAGKIASMYGNSGFSGEIALTFNGSAGQSFGAFNLPGMILTLNGEANDYVGKGMHGGELIVKPSDDSTLDSGENVIIGNTCLYGATGGTLFARGQAGERFAVRNSMGQAVIEGAGDHCCEYMTGGVVVVLGKVGRNVGAGMTGGIAYFLDLDGSFPDCVNGEIVRIQRVATSQGEAQLRGLIQDHSDRTGSKVAASILANWSEFLPKFWQVVPPSEENTPEVSSAASNQKVAV

SEQ ID NO: 2012 - protein, 435 aa, Arthrospira platensis C1
MVSMKLNLHQIFQDHKVTPRGIIYVGAGEGRSLKRFAKFTNAQILLIEANPVTCERLKMAVGDRPNIQTVHVAIADQNSTATLHVTNIESNSSILSLTEYKKLYPNLTETQQIPVETRTIDSILTELNLLPEDYNILCLDIQGAELLALTGASEILQHLDAIYSTTSQNKLFEGGATFEQLNAFLNEHYFTPVAQATPYHPSRYEVVYIHNNLINTSVIPSEIAQNLRLQPPTEPKPTELKITQSRLQELESEQELLKYQLQQHQKDLEKSQSDFQQKQKELENSQSQLQQTRKDLEKSQSDFQEKQKELENSQSQLQQTRKDLDKSQSDFQQKQKELENSQSQLQQTRKDLDKSQSDFQQKQKELENSQSQLQQTRKDLDKSQSDYQQKQKELENSQSQLQQTRKDLEKSQSDFQQKKQKAVGKLSVSTTADSA

SEQ ID NO: 2013 - protein, 394 aa, Arthrospira platensis C1
MTTVLRAVPKGFVNTPAIERITVRALRYLQSGFSVHLRGPAGTGKTTLALHLADLLNRPIMLIFGDDELKSSDMIGNQTGYTRKKVVDNFIHSVVKLEDSLKQNWIDSRLTLACREGFTLVYDEFNRSRPEVNNVLLSALEEKLLVLPPNNSRSEYIRVNPHFRAIFTSNPEEYCGVYSTQDALLDRLITMNMPEPDEATQQEILIQKVAVTPEEAQTIVTLVQQFREATHAIAPSKIQTVARQQTNADKASGLRPSLMLARICQEHNIPIVPIDPDFQEVCRDILLSRAIGDIAELESRLHQIFDHLSGLENDQIIALPPREELTTSSVPNNLSDTEQKIYTYIKDSDGARVSEIEIALGLNRVQTTDALRSLLRKSYLTQQDNRLFVVYEGD

SEQ ID NO: 2014 - protein, 619 aa, Arthrospira platensis C1
MAKPTQEQLQQELEQTKSELRDVWEELERVQSQFEQVSGELQQAQTQIPQQETASDTDCQQELEAVRSQLNQVLAELEQAKTQIHQQEAEKAQLESLQQELQTTQDSLNTTRTQLDQVQTQIQQGETDKAELESVQQQLQETQAKLTSTTEELEKAKTQIQEAQGSKAQLESVQQHLQETQAKLTSTTEELEKVNCQFDEVLGELEETHFKLHQIQQETASDTESKQELERVNSQLNQVLGELEQAKTQIQEAQGSKAQLESVQQQLQETQAKLTSTTEELEKAKTQIQEAQGSKAQLESLQKELQTIQGQLTSTTEQLDLAQCQFDEVLGELEQAHIQAQQAQQEKAQLGSVQQELQETKEKFTSIQQELQQGQLKFDEVLEELEQAHIQAQQAQQEKAQLGSVQQELQETKDKLNNKTEELKQAQFMQKEAAEEVDKTKAELQEARQNLQTLRSQNEETEGLLRKCHAQLQETMEVLESSHSQHKQTQGELEQLRSQKEETEGLLEKCHAQLQETMQVLESSHSKQQQTQEELEQLRSQKEETEGLLRKCHAQLQETMEVLESSHSQHKQTQGELEQLRSQLQEKPQELTNHAVQVSPVPASPPAPVAVAAIDWETF

SEQ ID NO: 2015 - protein, 768 aa, Arthrospira platensis NIES-39
MTIALDQIDKIVWNHHHDPFEVLGPHQIEKDGKSLWAVRAYLPTADAAWVVLPEERKEYPMYSVHNPHFFECVIDIPELKNYKLRFKEGEHERVTHDPYAFRSPKLTDFDIHLFTEGNHHRIYEKLGAHPMNLNGVDGVYFAVWAPNARNVSILGNFNHWDGRKHQMRKFGNGVWELFIPEIGAGEAYKYEIKNFEGHIYEKSDPYGFQQEVRPKTASIVAELNNYKWNDDEWMEKRRNTDPLDHPVSVYECHLGSWNRAPFSEPHTLPDGTVEPPVQAVELDPGSRFFTYREMADQMIPYVKELGFTHIEILPVAEHPFDGSWGYQVTGYYAPTSRFGTPEDFMYFVDKCHQNGIGIIVDWVPGHFPKDGHGLAFFDGTHLYEHGDPRKGEHKGWGTLVFNYSRNEVRNFLVANALFWFEKYHIDGIRVDAVASMLYLNYCREDGEWVANDYGGCENIEAADFIRQTNHVIFSYFPGILSIAEESTSWPMVSWPTYVGGLGFNLKWNMGWMHDMLDYFHMDPWFRQFHQNNITFSMWYHHSENFMLALSHDEVVHGKSNILGKMPGDDWQKFANVRALFTYMFAHPGKKTIFMGMEFAQWKEWNAWGTLEWEMLQFDAHKGIQRFFKDINTLYRSEPALYDQDFAEAGFQWVDCTDNRHSVVSFIRRSKDTDEFVVVVCNFTPQPHSHYRVGVPEVGFYTELFNSDSGEYGGSNMGNLGGKWTDEWWFHNYPQSLDLCLPPLGVLILKLDKEKTAKAFQQSETDDGE

SEQ ID NO: 2016 - protein, 89 aa, Arthrospira platensis; identical to SEQ ID NO: 553
  source: /note="str. Paraca"

SEQ ID NO: 2017 - protein, 172 aa, Spirulina platensis
MFDAFTKVVSQADTRGEMLSTAQIDALSQMVAESNKRLDAVNRITSNASTIVSNAARSLFAEQPQLIAPGGNAYTSRRMAACLRDMEIILRYVTYAVFAGDASVLEDRCLNGLRETYLALGTPGSSVAVGVGKMKEAALAIVNDPAGITPGDCSALASEIASYFDRACAAVS

SEQ ID NO: 2018 - protein, 204 aa, Arthrospira platensis NIES-39
MLKAKDIMTTNVVTIRGSATVAEAVKQMNDLCLRALIVQRRHEQDAYGIVTETDVIYKVTAYGKDPKKMRVYEIMTKPCISINPDLGVEYVARLFAQTGIRRAPVIQEELLGIVSVTDILSKGDFVEKPKSIVLADRIEQAIEEARATCAAKGATSRECAAAWDIVEELQAEAAHQRSERIEKTAFEVYCEENPEAAEARVYDN

SEQ ID NO: 2019 - protein, 359 aa, Arthrospira platensis C1
MTTTIQQRESANAWERFCSWVTSTNNRLYVGWFGVLMIPTLLTATICYIIAFIAAPPVDIDGIREPVAGSLLYGNNIISGAVVPSSNAIGLHFYPIWEAASLDEWLYNGGPYQLVIFHFLIGVFCYMGREWELSYRLGMRPWICVAYSAPVAAASAVFLIYPIGQGSFSDGMPLGISGTFNFMLVFQAEHNILMHPFHMLGVAGVFGGALFSAMHGSLVTSSLVRETTEIESQNYGYKFGQEEETYNIVAAHGYFGRLIFQYASFNNSRSLHFFLGAWPVIGIWFTALGVSTMAFNLNGFNFNQSVMDSSGRVVNTWADVINRANLGMEVMHERNAHNFPLDLASAESEPVALVAPQIG

SEQ ID NO: 2020 - protein, 613 aa, Arthrospira platensis C1
MIGFFLWQGAFAASPTDIAQNNTASTRMTYGRFLDYLDAGRVTSVDLYEGGRTAIVEAIDPQLDNGVQRLRVDLPNNAPELISRLRAANISFDSHPPRNDGAIWGLLGNLVFPILLIVGLFFLFRRSNNVPGGPGQAMNFGKSKARFSMEAKTGVLFDDVAGVEEAKEELQEVVTFLKKPERFTAVGARIPKGVLLVGPPGTGKTLLAKAIAGEAGVPFFSISGSEFVEMFVGVGASRVRDLFKKAKETAPCIVFIDEIDAVGRQRGAGIGGGNDEREQTLNQLLTEMDGFEGNTGIIIIAATNRPDVLDSALLRPGRFDRQVIVDAPDIKGRLSVLEVHARNKKLADQVSLEAIARRTPGFTGADLANLLNEAAILTARRRKEAITMAEIDDAVDRVVAGMEGTPLLDGKTKRLIAYHEIGHAIVGTLIKDHDPVQKVTLVPRGQARGLTWFMPDEDQGLISRSQILARITGALGGRAAEDVIFGDAEVTTGAGGDLQQVAGMARQMVTRYGMSDLGPLSLESSQGEVFLGRDFATRTEYSNQIASRIDSQIKAIAEHCYQDACQIIRDHREVIDRLVDLLIEKETIDGDEFRQIVAEYTEVPEKERFAPVL

SEQ ID NO: 2021 - protein, 220 aa, Arthrospira platensis C1
MAAISAKLVKELRDKTGAGMMDCKKALKENDGDMTKAAEWLRQKGIASADKKSGRAATEGIVGSYIHTGGRVGVLVEVNCETDFVARREEFQELVRNIAMQIAACPNVEYVSVDDIPAAMVAKEKEIEMKRDDLGNKPDNIKEKIVQGRIDKRLKELSLVDQPYIRDQNISVEELIKQTISTLGENIKVRRFARFVLGEGLEKEETNFADEVAAQTGGKA

SEQ ID NO: 2022 - protein, 316 aa, Arthrospira platensis NIES-39
MSNLKAIRDRIQSVKNTKKITEAMRLVASAKVRRAQEQVLATRPFADRLAGVLYGLQGRLQFEDVECPLLQQREVKKVGLVVLAGNRGLCGAYNSNIIKRAEARAAELKAEGLEYSYLLVGRKAIQHFTRRDAPISQCRDNPEKTPDLQKVSSAADEILTWFESGAVDRVELIYTKFVSLISSRPVTQTLLPLDLQGLEAQDDEVFRLTSKGGKFDVTREKVSVEPEALAQDMIFEQDPVDILNALLPLFLTNQLLRAWQESTASELAARMTAMSNASDNASDLVKTLTLSYNKARQASITQQILEVVGGAVALEN

SEQ ID NO: 2023 - protein, 426 aa, Arthrospira platensis NIES-39
MSSTTVQAKYEIKDPTLASKGKQRIEWAGREMPVLRQIEERFAQEKPFEGIRLVACCHVTTETAHLAIALKAGGADAILIASNPLSTQDDVAASLVVDYGIPVFAMKGEDTATYLRHVEIALDHRPNIIIDDGSDVTATLVKNRQHQIPEIIGTTEETTTGIVRLRAMFNDGKLTFPAMNVNDADTKHFFDNRYGTGQSTLDGIIRATNVLLAGKNVVVVGYGWCGKGSALRARGLGANVIVTEVDPVRAIEAVMDGFRVMPMEQAAAVGDLFITVTGNKHVIRGEHFDVMKDGAMVCNSGHFDIEIDLKALAERSTEIKEVRNFTQQYKLKTGKSVVVLGEGRLINLAAAEGHPSAVMDMSFANQAMACEYLVKNKGKLEPGLHSIPQDVDQEIARLKLKAMGIAIDTLTPEQIEYSNSWTMGTD

SEQ ID NO: 2024 - protein, 805 aa, Arthrospira platensis NIES-39
MVAAADQSLETTYPLSDDEIRKTHAYWRACNYLCVGMIYLRDNPLLKEPLKPEHIKYRLLGHWGSSPGLSFIYIHLNRLIKKYDLNMIYIAGPGHGAPGVLGPVYLEGTYSEVYPDKSQDAEGMRKFFKQFSFPGGIGSHCTPETPGSIHEGGELGYSLSHAYGTVFDHPELITAAVVGDGEAETGPLATAWHSNKFINPIRDGAVLPILHLNGYKIANPTILSRIPNEELKNLFRGYGYTPYLVECSQLEDYASAHQKMATTLEHCINEIRDIQQQARSSGNATRPQWPMIILRSPKGWTGPKEVDGRKVEGFWRAHQVPMSNVIGNPHQMKILEDWMRSYQPEELFDENGTLIPELQELAPTGIRRMSANPFANGGILRRDLNMPDFRHYAVEVPKPGQSEAENTRPLGNFLRDVMAKNMTNFRMFGPDETASNRLNAVYEVSKKTWMGEFLEEDLDGSELATDGRVMEMLSEHTLQGWLEGYLLTGCHGFFHTYEAFAHVVDSMFNQHAKWLEVCKKEVPWRSPIASLNILLSSTVWRQDHNGFSHQDPGYVDLVTNKSPDVVRVYFPPDANCLLSCANHCLQSKDYVNVIVADKQKHLQFLNMDDAIKHCTKGIGIWEWASNDDCGKDPDIPDVVMASCGDVATRESLAATAILRSEFPELKIRFINVVDLFKLQPNTEHPHGLSDWDFDSLFTTDKPIIFNFHGYPWLIHKLAYRRTNHPNLHVRGYKEKGNINTPLELAIENQVDRFNLVIDVIDRVPQLRSAAAYVRERMRNAIIENVAYAYEHGQDQEEISNWKWPF

SEQ ID NO: 2025 - protein, 871 aa, Arthrospira platensis C1
MYSYFDSDTNDSKSFELPGARPHYNPDRPGQVEHIFLDLVLDIPAQSFQGTCTITLNPIRSGINTLTLDAVDLEINQVKIGKHEVDFDHDGQQLYVHLNQPTEVNQTLKIAIDYTVDHPQRGLYFIGPNSDYPDKPIQVWTQGEDEDSRFWFPCFDYPGQLATSEIKVRVPQDFLAIANGELIATKTKGDQQIYHWLQKQVHPSYLIALAVGKFAEIKEEYNQIPVVYYVEKNRQEDALRSMGKTPAMIEFLSQTFGYDYPYPKYAQVCVDDFIFGGMENTSTTLLTDRCLLDERATLDNRNTESLVVHELAHQWFGDLVVIAHWSHAWIKEGMATYSEVLWTEHEYGADEAAYYRLNEARSYFSEDSSRYSRPIVTHVYREAIELYDRHLYEKGACVYHMIRAELGDELFAKAIHTFVQDNAHKTVETVDLLRAIEKATGRNLLFLFDQYVYRGGHPKYKVSYSWDNDSKIAKVTIKQTQAKDSDKLSEANLFNLKIPIGFGYTKKSKGKSKKKSTPVELKTVTVQVSDREQSFYFPLEEKPNFISFDVGNNLLKTVTLDYPVAELKAQLQFDPDPISRIYAAQALAKKGNLASAKALGEAMVSEPFWGVRVEVAKQLVKVKLDQSFDGLVAGLKDENPRVRRAVVNALAEIHTAASYQAIKPLVENGDPSYYVEASAIQAIAKIAAGNTEDEPTEAEAIALLEMVLQERAGWNEVVRSGAILGLSQMKTSEMALNLILKYTANGVPQALRLNAISSLGRISTGQNNINLERIMQRIQELAKEDFFLTQISVVMALSQMETPKAIAVLNDLAEQTMDGRVRRRAEEAVQKVQKNLGSDKAIKQLREELDKIKKENQELRSRLENLEAKTK

SEQ ID NO: 2026 - protein, 220 aa, Arthrospira platensis
  source: /note="str. Paraca"
MAKISAKQVKELRDKTGAGMMDCKKALKENDGDMTKAAEWLRQKGIASADKKSGRSATEGIVGSYIHTGGRVGVLVEVNCETDFVARRDEFQELVRNIAMQIAACPNVEYVSVDDIPADIVAKEKEIEMKRDDLGNKPDNIKEKIVQGRIDKRLKELSLVDQPYIRDQNISLEELIKQTISTLGENIKVRRFARFVLGEGLEKEETNFADEVAAQTGGKV

SEQ ID NO: 2027 - protein, 287 aa, Arthrospira platensis C1
MAIRSYRPYTPSTRQHTVSEFTEITRSEPEKSLTVSKHRLKGRNNRGVITCRHRGGGHKKLYRIIDFRRDKHNVPAKVAEIEYDPNRNARIALLNYVDGEKRYILHPVGLAVGTVVISGPDAPIEVGNALPLSHIPLGTSIHNVEMIPGKGGQMVRAAGASAQIMAKEGDYVTLKLPSGEQRKIPARCYATIGQVGNVDARNISIGKAGRNRWLGKRPTVRGSVMNPVDHPHGGGEGRAPIGRSGPVTPWGKPALGAKTRNKKKRSTALIVRRRRKSSKRGKGGRQS

SEQ ID NO: 2028 - protein, 335 aa, Arthrospira platensis C1
MLLRLNAMADSSKSKPQDDKTPIQDKTSATKADTTPATSSTPTNQEPVAAKTPEPKPEPKPEPKPEPVAAKTPEPKPEPKPEPVAAKTPEPKPEPKPEPKPEPVAAKTPEPKPEPKPEPKPEPVAAKTPEPKPEPKPEPKPEPVAAKPPEPKPEPKPEPKPEPVAAKPPEPKPEPKAEPKPEPVAAKPPEPKPEPKPEPKPEPKPEPVAAAQPAAITTEPTLEGGVDMPEVDVTAIKEKVLDFFSNLPENFSKFFSEYYRPLTTVILIIVLFVTLRVLVGVIDIINQIPLVKPSLEMVGIGFSGWFVYRYLLRSETREELVNKWREFKKDVFGEN

SEQ ID NO: 2029 - protein, 340 aa, Arthrospira platensis NIES-39
MAIKVGINGFGRIGRLVMRYGSQHPDIQFVGINDLVPADALAYLLKYDSTHGRFNGKVESEDEAIVVDGQTIRCTSIKDPTQLPWKELGVDYVVESTGLFTNYDGAYKHIEAGAKRVVISAPTKDPEKVKTLVVGVNHQDFDPASHPIVSNASCTTNCLAPISKVIQDNFGLAEGLMTTVHSLTATQPTVDGPSRKDWRGGRGATQNIIPASTGAAKAVTLVLPELKGRLTGMAFRVPTPNVSAVDLTFRTEKATTYDEICAAMKSASEGAMKGILGYTDEDVVSSDFITDGHSSIFDAGAGIELNSNFFKIVSWYDNEWGYSCRVIDLMLSMAKADGLL

SEQ ID NO: 2030 - protein, 432 aa, Arthrospira platensis C1
MRLQDFVGTNTQYDIKAIYDNEALSRQIQTRLIDLGLLAPPVDGIFGPNSTAAFRSFQELMNCSEPSGILGTDTAKKLIETKSVNRQGNMRLQNFLGTDIRYDVKEINADAGLSRQIQIRLIDLGLLDPPADGIFGPKSTAALHRFQQLMECSEPGFIGSDTAKKLIEAKVSDLPVTTPMLKVIRDTVLKVRPIASSQLNNSEKFSISAGREFSVLAYDPIRAHLRIALRNESFGGYSVLYIWGGHAEVYEGGTQTYPRTLPTSHRLNVPFKSQLDNFYNPTGACNVTSLAMCLEYFNIPRRDTRYRQFEDELYRYAINKGYSRHSPYDLARIVRDYGARDYFTENAVIEDVQDWIAAGYPAVIHGYFTSFGHIIVVVGYDQNGFIVHDPYGEWFSSGYRTDLSGAYLHYSYQLIRRVCIPDGSFWVHFISK

SEQ ID NO: 2031 - protein, 575 aa, Arthrospira platensis NIES-39
MARLDYFAPGVYIEEVDRGSRPLQGVPTAVAGFVGFTEDIRGGAEPFKPMLVTSWKQYLEYFGRTNSDGFTEFGAYLPFSVYGWFLNGGGRCWITSMGTGLPGSPKPEVRETGTEIVNRANRPSLRFSIRENAEDSGSEGSLTDSSQNRFLAVSDRSIRVQITEGYPKPPSEETEASEAIVTANTGEFFTVVIRQGGEELERFPHLSMNPDIETAVADYVVSALEASEYIIATDLAISGSPLARRPSNGVYEVSPGAIIAETENLARHVEGVREERTGIRGLFEIDEVTIICCPDLMKVYEQGLIDLDQLHGLMDLMVSMCEGAADGDIPNAPNRMIILDPPPDRVKPQEISRWLSIEFNRRSQFAALYYPWILVPNPRNAGRPIAIPPSGHMAGVWARVDETRGVYKAPANEVPRGVIGLTHPCNFREQELLNPIGINCIRPFENRGIRIWGARTLVEPDKTEWRYINVRRLMSYIEKSIENGTQWVVFEPNDEDLWQRVKRTISSFLTELWRSGALIGGSPSEAFYVKCDAELNSPQSMMLGRLFVEVGVCPVRPAEFVIFRISQWTADGEGE

SEQ ID NO: 2032 - protein, 281 aa, Arthrospira platensis C1
MKSAQPQQGLPAIVLGIIVALAILIGLNSFVIINPGQAAVLSILGKAQDGALLEGLHFKPPIISAVDIYDVTVQKFEVPAQSSTKDLQQLSASFAINFRLDPVNVVQVRREQGTLQNVVSKIVAPQTQESFKIAAAKRTIEEAITQREELKADFDEALVSRLDKYGIIVLDTSVVDLTFSPEFARAVEEKQIAEQRARRAVYVAKEAEQQAQADINRAKGRAEAQRLLAETLKAQGGELVLQKEAIEAWRQGGSQMPKVLILGDSKSKVPFLFNVGDLTKS

SEQ ID NO: 2033 - protein, 372 aa, Arthrospira platensis NIES-39
MQSNKQPGQSQSQSPLAKATTTKPTTTTVVGRSTILSVDLGRTATKSCISRNPADVVFIPSNVAQLSVEKARGGGFESKNTDPLLDLWLEYQGNGFAVGQLAADFGASLFGVDPAANPSKVNDALIKIFACVGYFNLKGDLDVVLGLPFYSQEQFEREKEQIMSLLSGPNTLVFRGEQVVVDIQSVRVMPEGYGSLIWCEAQGSKDMPNFADLSVAIVDVGHQTTDFLTVDRFRFARGVSQSEVFAMSKFYEEVAAKIEGADAQSLFLLEAVHKPQGQRFYRPRGATKPANLDEIVPELRKIFARDLCDRVVKWLPERVTDVVITGGGGEFFWQDLQPLLKEAQLRAHLTQPARKANSLGQYVYGEAQLAKR

SEQ ID NO: 2034 - protein, 629 aa, Arthrospira platensis NIES-39
MPKLEQRFDYVKIGLASPERIRQWGERTLPNGQVVGEVTKPETINYRTLKPEMDGLFCERIFGPAKDWECHCGKYKRVRHRGIVCERCGVEVTESRVRRHRMGFIKLAAPVTHVWYLKGIPSYMAILLDMPLRDVEQVVYFNAYVVLNPGNADNLSYKQLLLEEQWLEIEEQIYAEEGELVGVEVGIGAEAIARLLEDIPLEEEAERLRTDIANAKGQKRAKLIKRLRIIDNFIATSSKTEWMVLNVIPVIPPDLRPMVQLDGGRFATSDLNDLYRRVINRNNRLARLQEILAPEIIIRNEKRMLQEAVDALIDNGRRGRTVVGANNRPLKSLSDIIEGKQGRFRQNLLGKRVDYSGRSVIVVGPNLKMHQCGLPREMAIELFQPFVIHRLIRQNLVNNIKAAKKLIQRGDPSVWDVLEEVISGHPVMLNRAPTLHRLGIQAFEPILVEGRAIKLHPLVCPAFNADFDGDQMAVHVPLSIEAQAEARLLMLASNNILSPATGRPIVTPSQDMVLGCYYLTAQNPKAVRGKDRYFSNLEDAIVAYNHGLLDLHAEIWVRFDGEVDLDEPEQLDREEKSADGSQTKLYVGHKSGNLTRRVREDKEGKMISQYVRTTAGRIIFNKTVLDALV

SEQ ID NO: 2035 - protein, 101 aa, Arthrospira sp. PCC 7345
MKTPLTEAVSIADSQGRFLSSTEIQVAFGRFRQAKAGLEAAKALTSKADSLISGAAQAVYNKFPYTTQMQGPNYAADQRGKDKCARDIGYYLRMVTYCLIA

SEQ ID NO: 2036 - protein, 145 aa, Arthrospira platensis C1
MLAIGKLFGRGQKSDYFLEFDEAKGTTAEPSPTVAPKAEAPKVEAPKAEAPKAEAPKADKPEKTKKSVAKKSPEAAKADVPATPAPAAVAKVAPSSAPLNGGMNKTPEGMTFATDYLLPKSTATRRRPGPNMNMFRDMARQMSSK

SEQ ID NO: 2037 - protein, 189 aa, Arthrospira platensis C1
MGRTLAQKENIVVDIQKQLSSAQLTLVIDYTGLSVSQITDLRNRLRETGSVCKVTKNTLMQKAVEGDDNWKPMEKFLSGSSAFIFIQDDFGAAIKAYQAFQKESKKTELRGGVMEGRALSPDEIKAITELPTKEELMARIAGAINSIPTKVAVGVNAVPTKLAVGIKEVPASLVRAIKAVSEKDDSQAA

SEQ ID NO: 2038 - protein, 210 aa, Arthrospira platensis C1
MVDCVIRNWEGEEVGQTTLELKVAKEENASHIVHRALVRQQAAARQGTASTKTRSEVRGGGRKPWRQKGTGRARAGSIRSPLWRGGGVIFGPKPRDYSVKMNRKERRLALRTAFQSRAEDIVVVEEFVTQLPRPKTKDLTDALARWGVSPEAKVLLVLPEKQENVYLSGRNVAKIRICLADSLNVYDVLAADKIVTTANALAKIQEVYGD

SEQ ID NO: 2039 - protein, 255 aa, Arthrospira platensis C1; identical to SEQ ID NO: 613

SEQ ID NO: 2040 - protein, 278 aa, Arthrospira platensis NIES-39
MKYRALVATFLAFCLSVLTACSESPSAKDPSLLTYDDIRNTGLAVNCPSLPETARGSIPLDQNASYEITGLCLQPTSYFVKEEPANKRQEAEFVPGRLLTRFTYSLDQVRGLLKFQPDGSLKFTEKDGIDFQPITVLLPGGEQVPFLFTIKGLVATSQPGLTSINTSTDFSGDFNVPSYRGSTFLDPKARGLASGYDNAVALPATADEEDYVNANVKLADTKFKAGHISLQVAKVDGETGEIAGIFESEQPSDNDLGAKEAVEVKIRGAFYARIEPKA

SEQ ID NO: 2041 - protein, 265 aa, Arthrospira platensis NIES-39
MPVISLADMLESGVHFGHQTRRWNPRMAPYIFTERNGVHIIDLVQTAQLMDDAYDYVRSASEEGKKFLFVGTKRQAAGIIAQEAARCGGYYVNQRWLGGMLTNWVTIKTRVDRLKDLEARENSGQLDYLPKKEAAVLRREMGKLQKYLGGLKGMRRVPDAVIMVDQRREYNAVMECRKLGIPIIALLDTNCDPDLADIHIPANDDAIRAIKLIIGKLADGIYEGRHGVSAVGADDDYDDADTDYDDEEFGDDYESDDDSDDSSDD

SEQ ID NO: 2042 - protein, 365 aa, Arthrospira platensis AV
VGYGWSEVESSFDWQKLTQAVDTEVKRLSQLHISFLEKAGVELIDGYAKFIDAHTLEVGDRKITADKILVSVGAKAVRPEIPGIEHSIVSDDMFLLPEQPKRFAVWGGGYIAVEFAGILNGLGSQVTEIIRRDLILRGFDQDLRSHIQEGMTKHGVNFRTNTTIEKIEKVEEGLKLTLTGDDTEPLIVDALLCATGRQPKLDGLNLENAGVETIKGAIAVTQDSRTTQSNIFAVGDCTDRVNLTPVAIAEGRAFADTEFGHLPRSISHDNIATAVFSQPEAATVGMTEAQAQEKFGDSIKCYRAVFRPMFHSLTGADEKVLMKLIVETNTDRVLGAHMVGKDSAELIQGIAIAVNMGATKKDSTT

SEQ ID NO: 2043 - protein, 134 aa, Arthrospira platensis NIES-39; identical to SEQ ID NO: 624

SEQ ID NO: 2044 - protein, 150 aa, Arthrospira platensis NIES-39
MLAIGKLFGRSKKSDYFLEFDEAKGTTAEPSPTVAPKAEAPKAEAPKAEAPKAEAPKAEAPKAEKPEKTKKSVAKKSPEAAKANVAATPAPAAVAKVASSSAPLNGGMSKTPEGMTFATDYLLPKSTANRRRPGPNMNMFRDMARQMSSK

SEQ ID NO: 2045 - protein, 182 aa, Arthrospira platensis C1; identical to SEQ ID NO: 498

SEQ ID NO: 2046 - protein, 398 aa, Arthrospira platensis NIES-39
MINQTLTSRDVGFTHEDFAALLDKYDYHFSPGDVVPGTVFSLEPRGALIDIGAKTAAYIPLQEMSINRVESPEEVLQSNETREFFILTDENEDGQLTLSIRRIEYMRAWERVRQLQAEDATVRSQVFATNRGGALVRIEGLRGFIPGSHISTRKPKEELVAEELPLKFLEVDEDRNRLVLSHRRALVERKMNRLEVGEVVIGTVRGIKPYGAFIDIGGVSGLLHISEISHDHIDTPHSVFNVNDEVKVMIIDLDADRGRISLSTKQLEPEPGAMVKNPEMVYEKAEEMAAKFREKMQAEQQGIPVVETAPETASETASETASETASETAETEESTAEIPSATDVDTEAELSVPTEEQPISESESESESEAIAQPVAETEAVEDSVEDSVEEIPIATES

SEQ ID NO: 2047 - protein, 457 aa, Arthrospira platensis NIES-39
MRVCVIGTGYVGLVTGVCLAHTGHDVICVDNNEEKVKLMKSGQSPIYEPGLSELMKSCAESGKLSFTSDLKAGVEHGDILFIAVGTPPLPTGESDTRYVEAVARGIGANLTRGSGYKVVVNKSTVPIGSGDWVRMIVLDGFTEQQKEQGTSGSAGELQFDVVSNPEFLREGSAIFDTFNPDRIVLGSNSQKALGLMQELYQPIVDRKYADDPDLPPVPVVMTDLSSAEMVKYAANSFLATKISFINEIANICDRVGADVKQVATGIGLDSRIGNKFLQAGIGWGGSCFPKDVSALIHTADDYNYDAKLLKSAVEVNDQQRVIAIEKLQQVLKILKGKTVGLLGLTFKPDTDDMRDAPALNLIEQLSRLGARVKAYDPIISQSGMRHGLSNVMVETDPELMADGCDALVLVTDWEQFQNLNYAKMVKSMHTPVIIDGRNFLDRKKLQELGFQYVGIGH

SEQ ID NO: 2048 - protein, 466 aa, Arthrospira platensis C1
MKVTQEKLPASQVGLDIEISPEISKKAYEKVINQYARSANIPGFRKGKVPRHILVQRLGPSRIKAAALDDLMQEYFPKIVEEEKIPAIGSFEVIGNIEELIEQYEPGQPITIKAAVDVEPEVKLNKYQDFQVQAEEVKFDPQQVDEILERERVKMATLVPVENRPAQKGDTAYVDFKGYFTPTGATEPQEIEGGQGDNYQVELTEGQFIPGFTEGIEGMSPGETKELNIEFPADYGKPELAGCPATFNITLLELKEKELPELDDDFAAEVSEFETLAELRESLEKRFQEEKAEQTTANKHKALAEALVAEMEVELPETLIREEVDRLLTQQAMQLSNMGIDLKQLFNSETVPRMREHLRPDAIAQLKETLAIKEVAKQQSITITEEEIQAKSEEMMEQLQGQDVNLDRLRMVVTDDLISQKTYQWLEEHSTIELVPEGTLTPEEEEPEDSEDSEEVVVAEAEVVTD

SEQ ID NO: 2049 - protein, 575 aa, Arthrospira platensis C1
MARLDYFAPGVYIEEVDRGSRPLQGVPTAVAGFVGFTEDIRGGAEPFKPMLVTSWKQYLEYFGRTNSDGFTDFGAYLPFSVYGWFLNGGGRCWITSMGTGLPGSPKPEVTETGTEIVNRANRPSLRFSIRESSQDGASESSLADSSQNGFLAVSDRSIRVQITEGYPKPPSEETEASEAIVTANTGEFFTIVIRQGSEELERFPHLSMNPDIETAVADYVVSALEESQYILATDLAISGSPLARRPSNGIYEVSPPAIIAETDNLARHVEGVREDRTGIRGLFEIDEITIVCCPDLMKVYEQGLIDQDQLHGLMDLMVSMCEGAADGDIPNAPNRMIILDPPPDRVKPQDISRWLSQEFNRRSQFAALYYPWILVPNPRNAGRPIAIPPSGHMAGVWARVDETRGVYKAPANEVPRGVIGLTHPCNFREQELLNPIGINCIRPFDNRGIRIWGARTLVEPDKTEWRYINVRRLMSYIEKSIENGTQWVVFEPNDEDLWQRVKRTISSFLTELWRSGALTGGSPSEAFYVKCDAELNSPQSMMLGRLFVEVGVCPVRPAEFVVFRISQWTAEGDGE

SEQ ID NO: 2050 - protein, 2386 aa, Arthrospira platensis C1
MDFGLNEAREFSDFFSASFYAEANPDLAAITQETLVSKFAHFLGFGQFENRRFSRVFDANTYLQLNPDVSQLLQESANLGIQISAFSHFITRGRSENRQFSNIFDVSEYLQLNPDLVPFVESGQINAIDHWVRFGISERREFSLSFSVSQVLRTLSLSSLTEINISELFAQIESNLALILESDDDVDDDVDDDVDDDVDDDVDDDVDDDIDDDVDDDVDDDIDATAPEIPQIPPLPVIPPIAEQPEPEPEPEPEPEPEPEPEPEPEPEPEPEPEPEPEPEPEPEPEPEPEPEEPELPLDVVLDVDYILTTYEAELRIAFGVQDVTTISTRELLDWLDENALEAGINPSPFVDIQFYVRTFGQQLTEFYSVSSVEELSYLQIVNFIEGEGLERGFSPSPNINFAHFQATYSSQIEAFFRTSIENITNAQLFSYIVEVGLEQGQSPSVLIDLNFILSNQQSVTAIESHFGTEIANLTNAQIVRFISSDEGLERVTPSTLVSLNYFRAVHRQRLEAFFGVEIAEITNSQVFTFVNTIGLQEGLNTSAQLGFSYLQSIYGERITAALGEGATQQEVLAFIQREGLPENVNPSVFVHLDFVQQSQSQEVQEFFNVESATQLSEQQVINSIQANVKVDVNYVVTQYAEQLAEFYEIEVEQVNSLSSEQVISFTLGAGANLGVNPTPINLAEIRRLFGTELQAFFGVSDVRFLSDSQVNSFVINQSRVSGRVNELVNVVNVNYYQTIFSEALTATFGEDFTEENVVQFVFGDAAPAINIRFAKIKYRAALEQQAQSLGRTLETLTDDEVRLYLFTEGFDVENTLTPFNLEVVRTEYAAQLRAFYGVRNVAVLSEQQIYRFVVGQALEQGLSLAEVVDEEALEILREEYSSLLIEFYGVENVETLSTNVVLDFIYGGLSQIVDYDYFRFTFTGDVEATFGVESISEVTKLQIVEYLYEQEVSVSSLHWFNVEAYLEEHGSAAETAIAQFFRVSSINELSVTQIRDFALNIGVQQFSIEGALNIDYIRETFNAAIVSSDLAVNAWLESFSFLNVDTAYVQNQLEGLLLDETLTLEQVNEILGTEIEGLDELSDRHLITLVFDADFQEIIGDVEIQLFQETLNIDYVRTVFASAIAHTLEVDIAAVTGEEVLTVSDEQLDEFLLAQSEEIASELEIDADDVTLELAQEWFITNSVTTVEGLSVEVDIAYVKYQLQRSLDDEQFSLEDINSILDEPVEEFDDLTDEQIVDLGLNAEFQAEFSLEISLVQTELSIGFVVSRFSSELAEFFDLSPEEFAAKEFTQEEIIEFFSSTQAEAIAEFLGETVVGGEDDDDLDDEDDEDDDSDDDEDDEDDDSDDDEDDEDDDSDDDDDDEDDEDDDSDDDEDDEDDDSDDDEDDEDDDSDDDDDDEDDDEDDDDDEDDEDDEDDDEDDEDDDDDDQDDDSDDGPVFAAEDVLAYIEQLMVDVETVTQTEEIDIEFVTYQLEELFQASVFSLEDVNTILETEYESVDELTTEDIVTLAFSVEFQEVLGEDVEIELVQSEVNYSYLRASQAQAIADLFSTEENPITVEDVLRGEIEPLTDAEILAAFEENFLTADVGFIRYQVEQLLTETTITIEQVNESLSLEESIEAIVELNDAQIINLVYNREFQALLMEAEQTIELSAINYEAFIEANAETLIQQFGVDDVTELTLEQVHGFMFSGQVSIQGFVNFDYLRETFMSAIASQELPDSTILDWFNTDFSLINVNFLNAQFNQFTAAVQTQLLDSLGIELNEGESLSHQQLIEIFYSSEFQTITGIETLQTLAFDWQGYAEANAEALADFYQAFLVPAIPEGQAPNSVVVELSNFTGAEAQVTVTLEEVEGGIQFTVDGVEPIADINGVFFNIEDSSLLDSLSVSGDDVTNSNFSGDVKRVRNTSISPLKFDAGVQIGTPGIGRDDIQSTVFVITADGEELSLDQFVGQEFGVRLTSVESEGSRSASSKLRGTAEAVFTADGDDVGVIDVSSLSAEQVFNFAFQQGWQLGINPLEFVEVDFLRQQFAVDIARAYNIDVSAVASLESSLVLDYVYGGLSTQIDFEFYRTKYAASLQSTFGISAESLTRAQILEHAYTVGLEQGFNFVAIDYDAIATQYPQVFADFFGIPVEEIFNLDLSILQSFDLGIASELGIDISPFVDIEFFRQQASEQILQNYRIENVFRINSQQLFEFSLQGNFSTAPTIDLNWALTQYADFLAENLADFDQDDDGEIDNSELFDALTGQLLEQGNETSDIYSFEQYFESEDVQEEVAEFFGVESFEDVTFTQRLEYMFGAGLLAGIDPYSEEFLEANPQMAMDIYLEENSAALIEFAGVRSINQVTFLDVYNFQAINEINAFSGISTIDDIDDIDDIIDDIIDEVDAFSV

SEQ ID NO: 2051 - protein, 120 aa, Arthrospira platensis NIES-39
MKLTRNDSRQRRHRRVRRKVLGTSERPRLAVFRSHKHIYVQVIDDSQQHTLVAASTLDPEITADLKTGATCDASVKVGQLIAQRSLSKGIERVVFDRGGYIYHGRVKALADAAREAGLEF

SEQ ID NO: 2052 - protein, 161 aa, Arthrospira platensis NIES-39
MTVVSQVILKADDELRYPTTGELKNISDFLKTGEQRLRIVDTLTENEKKIVDRASAQLWKKRPDFIAPGGNAAGQRERSLCLRDYGWYLRVITYGILSGDKDPIESIGLIGVKEMYNSLGVPMPGMVEAIRCLKEASLALLDDEDAKEAAPYFDFIIQAMS

SEQ ID NO: 2053 - protein, 174 aa, Arthrospira platensis C1
MSVRLYVGNLPKELDRKELQAVFAEEGDTISAKVITDRKTGKCRGFGFVTVQSDDLADQIVEKYNGFMFGENALKIERAQPRKKNKPESEEGRSSDGGEATATATPGVVAANQSPTSSPSSAPTKSGGGKKKKSNRNQQGSANANSSSTPDSIQPDPRWANELEKLKQMLSAQA

SEQ ID NO: 2054 - protein, 173 aa, Arthrospira platensis AV
MAFELPSLPFDQDALESSKMSANTLSYHHGKHHAAYVKNLNAAIEGTDMANMSLEEIIKATYNDPSKSGIFNNAAQVWNHSFFWKCLKPNGGGQPTGALADKIQADFGSFDAFIQEFKNAAATQFGSGWAWLVLDNGTLKVTKTANAVNPMVEGKTPLLTLDVWEHPLLSELP

SEQ ID NO: 2055 - protein, 321 aa, Arthrospira platensis NIES-39
MVQDQKSTVIVTGASSGVGLYAAKALADRGAHVIMACRNLEKAEAAAQELGIPEDSRTMLHIDLGSLESVRRFINSFRATGRTLEGLVCNAAIYMPLIKEPLRSPEGYELTMTTNHLGHFLLCNVMMEDMKRSLAEDKRMVILGTVTHNPDELGGKIPPRPDLGDLEGFAKGFREPVSMIDGKKFEPVKAYKDSKVCNVLTMRELHRRYHEETGITFTSLYPGCVADTPLFRNHYPLFQKIFPIFQKYITKGYVSQELAGERVAAVVLDEEYRQSGAYWSWGNRQKKGRQSFVQRVSPQARDEERAEKMWNLSLKLVELAY

SEQ ID NO: 2056 - protein, 352 aa, Arthrospira platensis NIES-39
MTIAVERPQVTRGWFDVLDDWLKRDRFVFVGWSGILLFPCAYLSIGGWLTGTTFVTSWYTHGLASSYLEGCNFLTAAVSTPANSLGHSLLFLWGPEAQWDFTRWCQLGGLWAFVALHGAFALIGFCLRQLEIARLVGIRPYNAIAFTGPIAVFVSVFLMYPLGQSGWFFAPSFGVAGIFRFILFFQGFHNWTLNPFHMMGVAGILGGALLCAIHGATVENTLFEDGEGSNTFRAFEPTQAEETYSMVTANRFWSQIFGIAFSNKRWLHFFMLFVPVTGLWMCSIGVVGLALNLRAYDFVSQELRAAEDPEFETFYTKNILLNEGIRAWMAPADQPHQNFVFPEEVLPRGNAL

SEQ ID NO: 2057 - protein, 394 aa, Arthrospira platensis NIES-39
MSRIETRTEPMVINMGPHHPSMHGVLRLIVTLDGEDVVDCEPVIGYLHRGMEKIAENRTNIMYVPYVSRWDYAAGMFNEAVTVNAPEMLANIEVPKRAQYIRVIMLELNRIANHLLWLGPFLADLGAQTPFFYIFREREMIYDLWEAATGYRMVNNNYFRIGGVAADLPYGWVDKCHDFCDYFLPKVDEYEKLITNNPIFRRRIEGLGVITREQAINWGLSGPMLRASGVNWDLRKVDHYECYDDLDWDVHWETDGDCLARYVVRIREMRESVKILRQALDGLPGGPYENLEAQRMMGGPKSEWNNFDYQFIGKKIAPTFKIPSGEHYVRVESGKGELGIYIIGDDNVFPWRFKIRAADFNNLQIFPDLVKGEKVADIVAILGSVDIIMGSVDR

SEQ ID NO: 2058 - protein, 442 aa, Arthrospira platensis C1
MTINPKISPAFAPFLSNTDPQGKQDAIVIFQGQYPTNIAPRDSQQRFNTIQQTATSHQAEVSKLAASYKSAVGQNFNVSAIGSGALPIATVEVTAETLPALVEQPGVVAVLPNQKIKLIEPSAIDYQQLRRQEENNKLTWGLELLEIPKMWEKTKGKGVTVSVLDTGVHGDHPALKDRVKGFVVIDPLGRRITATPSFDGGNHGTHVCGTVAGGKTESGVSIGVAPEADLLAGGVLIGNATLRTLIEGISWSIENGADVINMSLGMSYYEPLFAQVFDMLINQYDVLPVVAVGNENHGNTSCPGNAHNAFSIGAVEMLPNSELGITFFSSGASLVFPDDAPNRLVTKPDVSAPGAQVYSAVPPTKQANGSFEYTYMDGTSMATPHVAGVVALLLAAQPDVPVSKIVEVLRETAEHPGGEQMRPDNRWGWGLIKPWEALQALK

SEQ ID NO: 2059 - protein, 438 aa, Arthrospira platensis NIES-39
MVVSREKTPTAQETFMQMAQAAGLRGRILVTIGLLILVRLGVFLPIPGIDRQAFSQNIQNTPFIGFLDLFSGGGFSALGIFALGILPYINASIIMQLMTAALPTLEDLQKNEGEAGRRKISQITRYVALGWAILQSIGIAIWVSPFAQNPNQPQFIVMAEVVLALAAGSMFVMWVSELITERGIGNGASLLIFINIVAVLPQSLGSTIELAQSGDSAIVGRVVILLLIFLAMIVGIVFVQEGTRRIPIVSARRQVGRKLYREKSSYLPLRLNQGGVMPIIFASAVLILPASISQFANNPILVQISTYLSPGGPAPWVYIAFYLLMILFFSYFYASLIMNPVDMAQNLKKMGASIPGIRPGRATSEYIERVLNRLTFLGAVFLGLVAIIPTVVESATRVPTFRGFGATSLLILVGVAIDTAKQVQTYVISQRYEGMVKK

SEQ ID NO: 2060 - protein, 533 aa, Arthrospira platensis C1
MPRKKKRGVTTLYSETKVKIGVSLTPTGAKLLSTTAKELGLSRSEFVERIARGDFKISMDEEGTTISLANTNTQTEVDDQSDDSPAITAELEKRSAEYDQLQQEYETLQKQVIEQANTIAELEQKLGHFPELQAQLENSVPAKEYHHVQQELQQHKDSITDLKKQLKRIGELESKLANTVSLEDHEALKQQNQETLNQLQSQLGDSQKLQQQLEQQKSTVADWQSQLKQTVTAEVHQKLQQQLEQQKSTVADLQSQLKQTVTAEVHQKLQQQLEQQKSTVADLQSQLKQTVTAEVHQKLQQQLEQQKSTVADLQSQLKQTVTAEVHQKLQQQLEQQKSTVADWQSQLKQTVAAEVHQKLQQQLEQHKSTVADLQSQLSASVSMDTYQKLEQEAEQHKNLINQLQEQLENRQTEIAEVRQKLTRIAELEAMISQTVPADKYSALQIQSEHQRYMVETMKKQLWDLVSSDHNLEFGELETVDGLVKCCGLVRQKLESQTRAISALQQRTQELQSLAMLAESHLNKWSNRIFSKTY

SEQ ID NO: 2061 - protein, 610 aa, Arthrospira platensis C1
MSDLFKGFEQLLELVKALEEKVENGEIKTEYQFNSRSLSSIPRTGNIPRPNNTTSNVGTSSIRTPSSPPRNTGASDPNVQPEPNLGITLKDIGGLNQELKELKELIAIPLKRPDLLVKLGLEPTHGVLLVGPPGTGKTLTARALAEELGVNYIALVGPEVITKYYGEAEQKLRAIFEKAAKNAPCIIFIDEIDSLAPNRSAVEGEVEKRLVAQLLSLMDGFSQNKGVILLGATNRPDHLDPALRRPGRFDREIQFRVPDINGRKEILEVLTRAMPLDDSVDLEFIADHTVGFVGADLKAVCQKAAYTALRRQVPSIDMQIPEDIAVEQSDFLQALKEIKPAVLRSMEVEVPHVEWEDIGGLETIKQTLRESVEGALLYPELYKETKARAPKGILLWGPPGTGKTLLAKAVASQARANFIGINGPDLLSRWVGASEQAVRELFAKARQADPCVIFIDELDTLAPARGTYTGDSGVSNRVVGQLLTELDGLESGSNILVIGATNRPDAIDPALLRAGRLDLQLKVDLPNLDSRFKILQVYNQGRPLLNVDLEHWAKITEGWNGADLVLLCNQAAVGAIRRFRSQGETDTAAIKITVDDFQASYEALSQQRTV

SEQ ID NO: 2062 - protein, 612 aa, Arthrospira platensis NIES-39
MNKRWRNAVLYAMLAIVVIALATTLFDQQPQSRETWKYSTFVQEVQQNRVERVSISADRTKALVTAQDGSKILVNLPNDPDLINILSENNVDIAVQPQTEEGLWFRALSSLFFPILLLVGLFFLLRRAQNGPGSQAMNFGKSKARVQMEPQTQVTFGDVAGIEQAKLELSEVVDFLKNADRFTAIGAKIPKGVLLVGPPGTGKTLLAKAVAGEAGVPFFSISGSEFVEMFVGVGASRVRDLFEQAKANAPCIVFIDEIDAVGRQRGAGLGGGNDEREQTLNQLLTEMDGFEGNTGIIIIAATNRPDVLDAALMRPGRFDRQVVVDRPDYSGRSEILQVHARGKTLGKDVDLDKIARRTPGFTGADLSNLLNEAAILAARRNLTEISMDEVNDAIDRVLAGPEKKDRVMSEKRKTLVAYHEAGHALVGALMPDYDPVQKISIIPRGRAGGLTWFMPSEDRMDSGLYSRSYLQNQMAVALGGRLAEEIVFGEEEVTTGASNDLQQVTRVARQMITRFGMSDRLGPVALGRQQGNVFLGRDIMSERDFSEETASAIDEEVRALVDEAYKRARQVLEENRPVLDSLAEMLIEKETVDSEELQELLASSDVKMAAIA

SEQ ID NO: 2063 - protein, 606 aa, Arthrospira platensis C1
MRLQDFLGTNTRYDIQQIDDDEALSRQIQTRLIDLGLLDPPADGIFGPLSTAAFKRFQELMNISESGILATETAQKLLDTTTMRPPNMRLEDFLGTNIRYEIQAIYDNEGLSRQIQTRLIDLGLLEPPVDGIFGPLSTAAFRRFQELMNISESGILGSETAKKLIETTTIRRENMRLQDFVGTNIRYDFQAIYDNEALSRQIQIRLIDLGLLAPPVDGIFGPLSRAAFRNFQELMNCSEPSGILGTDTAKKLIETKTVSRPGNMRLQDFLGTNLRYDVKAINADAGLSRQIQIRLIDLGLLDPPADGIFGPKSTAALHRFQQLMECSEPGFIGSETAKKLIETKVSDLPVTTPILKVIRNTVFKVRPIASSQLNNSEKFSIPAGREFSVLAYDPIRAHLRVALRNESFGGYSILYIWAGHVEVYEGGTRTHPRPLPTSRRLNVPFKSQLDNFYNPTGACNVTSIAMCLAYFNIPRRNLRYRQFEDELYRYALDMGYSRHNPYDLARIVRDYGARDHFTENAVIEDVQDWIAAGYPAVIHGYFTSFGHIIVVVGYDQNGFIVHDPYGEWFSTGYRTDLSGAYLHYSYRLIRRVCIPDGNFWVHFISR

SEQ ID NO: 2064 - protein, 694 aa, Arthrospira platensis C1
MTNNVASENRNVAIVGPYLSGKTALLESLLFATGTITRKGTAKEGNRIGDSVAEARDRNMSVEINAAYTEYGGINFTFLDCPGSVEFAQETYNALMGAGLAIVVCEPEPLRILTLSPLFKFLDDWEIPHIVFINKMDRAFSDEEGCTLNFLELLNALKTVSSRPIVPQEYPIAKGSELIGFIDLVTEQAYNYHPGAASDPVPMPEELKDLEHAARQEMLEQLSNFDDHLLEELLEEIEPPTEEIVKDLKMELGADLIVPVFFGAAELEYGVRSLLDALVREAPEPSLTAERRGLKGTSDIPIAQVLKTFYTPQGGKLSLVRVWQGELTEGIVLNGIRAAGMYRLLGQQTQGVQVAKTGEIVALARMEGIKTGDTLTAQPDRLKAPLPKAQVLPPVLAFAIAPENRKDEVKLSAALTKMIEEDPSLTWEQNTDTHQVILWGQGEIHLKVTLDRLRRKYNLPIVTSPPQIPYKETIRSNTNSHGRYKHQSGGHGQFGDVYLDITPLPRGEGFNFSETIVGGAVPKQYIPGVEMGVREYLQQGPLGFPVVDVSVTLTNGSYHSVDSSEQAFKQAARLAMQTGMAKCNPTLLEPIVTVEVCAPNDFTSQLFQLITTRRGQILGYEPVADWKGWDQVSAYLPQAEMQDLIVELRSLTMGVGYFNWKFDHLQEVPEQLAQRVLATVADDSNGGGNSKSKN

SEQ ID NO: 2065 - protein, 888 aa, Arthrospira platensis NIES-39
MVNRVTNIEELENLIARVKAAQQEFSGFTQEQVDYIFKKAALAANAARIPLAKIAVEETGMGVVEDKVIKNHFASEIIYNKYKNTKTCGVIESDKSFGFQKIAEPVGILAGIVPTTNPTSTAIFKALIALKTRNGIIFSPHPRAQKCTNEAARIILEAAVEAGAPEDIIGWIDEPTVPLSQALMQHQDIKLILATGGPGMVRAAYSSGRPSLGVGAGNTPALIDDSAHIKMAVSSIILSKTFDNGMICASEQSVIVVDSIYDQVREEFLSRGAYFLTPEETDRMANVIFVDGHLNPEIVGQTVNKLGGMAGLNLPDNTRVIIGERPEIDDDDPFAHEKLSPVLVMYRAKDFEDAVLKAERLVQLGGRGHTAALYTSPNNTAHINAFEGKVQTARVLINTPSSQGAIGDLYNFRLDPSLTLGCGTWGGNSISENVEPTHLLNIKTVAERRENMLWFRVPPKIYFKYGSLPVALRELAGKKRAFIVTDKPLFNLGITASLEEVLEEIGVKYDVFYDVEPDPSLDTVQRGLTLMNTFEPDVIIAIGGGSPMDAAKIMWLMYEHPDIEFEGLAMRFMDIRKRVYDLPPLGEKALMVAIPTTSGTGSEVTPFAVVTDRRNNIKYPLADYALTPNIAIVDPELVLNMPKSLTSFGGIDALTHALEAFVSVLASEYTNGMALEAIRLIFKYLPSSYKNGANDPKAREKMHYASTMAGMAFANGFLGICHSIAHQLGGTFHIPHGLANALMISHVIRYNATDAPFKQATFSQYKYPNTKWRYARVADYLHLGGNTDDEKIDRLILAIEELKHQVGIPKAMKEVVKESEAEFLAKVDEVADQAFDDQCTGANPRYPLIEDLKQLIIDAYYGHPVVASENNGKTVFPTFGPEPVMMGE

SEQ ID NO: 2066 - protein, 1193 aa, Arthrospira platensis NIES-39
MNTRQYATLDGNEAVARVAFRLNEVIAIYPITPSSPMGEWADAWTSEGQPNIWGTVPAVVEMQSEGGAAGAVHGSLQGGSLTTTFTASQGLLLMIPNLYKIAGELTCAVLHVAARSIAAQALSIFGDHSDVMAVRATGCGLLCSASVQEAHDLALVAQASTLKSRIPFIHFFDGFRTSHEVQKIELLEESDLRAMIDDEDIYAHRARGLTPDRPALRGTAQNPDVYFQARESVNPFYNACPEMVQKAMDKFGELTGRHYKLFEYHGAPDADRIIILMGSGCETVHETVDYLTAQGEKVGVLKVRLYRPWDANAFIGAVPKTAKAIAVLDRTKEPGSSGEPLYLDVVTAISESWEGLAPKIVGGRYGLSSKEFNPAMVKAVFDNLQLDKPKNHFTIGINDDLTHTSLPFDPEFSTEPDNVIRAMFYGLGSDGTVGANKNSIKIIGDETSNYAQGYFVYDSKKSGAVTVSHLRFGPNLIRSPYLIEKSNFIGCHQWNFLEKLNVVDAATNGATFLLNSPYGPDEVWNYLPIEIQEQIVRKNLKLYVIDANKVARDSGMGSRINTVMQVCFFALAGVLPKDEAIAKIKKAIEKTYGKKGSAIVRMNLQAVDNTLDNLFEVNIGEANSHVRIASPVPANAPDFVREVEGMMLARKGDQLSVSQLPCDGTYPTGTSKWEKRNVAQEIPVWDADVCVQCGKCIMVCPHAVIRGKAYDESALNGAPETFKTTAVRDKAFEGQKFTIQVSPEDCTGCGICVDVCPAKNKSMPSKKAINMEYQPPIRATERDNWEFFLNLPNPDRRNLRSDMIKQQQWQEPLFEFSGACAGCGETPYIKLATQLFGDRMVVANATGCSSIYGGNLPTTPWAQNAEGRGPSWSNSLFEDNAEFGLGFRLSIDKHTAFACELLQTLGGIVGDELVAKIINNPQKSEADIWEQRELVAQVKQKLQGSDDTNAKQLLSLADYLVKKSVWILGGDGWAYDIGYGGLDHVIASGRNVNILVMDTEVYSNTGGQSSKATPRGAVAKFAAGGKPSPKKDLGLIAMTYGNVYVASVAMGARDEHTLKVFLEAEAYDGPSLIIAYSHCIAHGINMTTAMSHQKAIVESGRWLLYRYHPDLKAEGKNPLLLDSRSPKKSIEQSMYAENRFKMLTKTKPVDAKRLLKEAQKDVDTRWQMYEYLAARPLNDEGNKPNTDTSGDKE

SEQ ID NO: 2067 - protein, 103 aa, Arthrospira platensis NIES-39
MAAVSLSVSTVKPLGERVFVKVSASEEKTAGGILLPDTAKEKPQVGEIVAAGPGRRNDDGSRCEMEVKVGDKVLYSKYAGTDIKLGGDEYVLLAEKDILAIVN

SEQ ID NO: 2068 - protein, 107 aa, Arthrospira platensis C1; identical to SEQ ID NO: 586

SEQ ID NO: 2069 - protein, 116 aa, Arthrospira platensis NIES-39
MSQQAVGALETKGFPGILAAADAMVKAGRVTLVGYIRAGSARFTVMIRGDVSEVKTAMDAGIAAVEKVYGGALETWVIIPRPHENVVAVLPIDFSDAVEEYRAAAEGLTLPRGNAR

SEQ ID NO: 2070 - protein, 152 aa, Arthrospira platensis NIES-39
MSKRTQVVLTKDVSKLGREGDLVEVAPGYARNYLLPYSFAVRATPGILRQVERRREEERQRLIELKQQAQSRKTALETIGRFTIAKQVGENEAIFGTVTTSELAEAIQKATGQEVDRRGITLPDINKIGFYKAEIKLHPEVTATVEIHVVAE

SEQ ID NO: 2071 - protein, 162 aa, Arthrospira platensis C1
MRRLLALVLALGLWFGGSAAAEAYNLTPCSDSAAFQQRAQTSIARSANPDQAKARFERYSQELCGEDGLPHLITDGSLSHAGDFLIPSVLFLYIAGWIGWVGRSYLQYAQKDKKPTEKEIIIEVPKAVQLMLGGFLWPLAALKEMTTGEMFAKDNEITVSPR

SEQ ID NO: 2072 - protein, 162 aa, Arthrospira platensis NIES-39
MRRLLALVLALGLWFGGSAAAEAYNLTPCSDSAAFQQRAQTSIARSANPDQAKARFERYSQELCGEDGLPHLIVDGSLSHAGDFLIPSVLFLYIAGWIGWVGRSYLQYAGKDKKATEKEIIIDVPKAVQLMLGGFLWPLAALKEMTTGEMFAKDNEITVSPR

SEQ ID NO: 2073 - protein, 170 aa, Arthrospira platensis C1
MKSKLLGGLCVLITAFMPVKAFAQIGVPTTPSDFDIRYQRPDPQTGRVTPPRYYSLPDLANPFRTLPSAFRYPIIYELGVNRNIRSDAVITDEVFIPNLPPIPAGITLDNIPRVRAEYTRRVEEWGERVQECKRLDPLIIKTDTGNPVLINQRSAGRIVLNANNISVCPR

SEQ ID NO: 2074 - protein, 195 aa, Arthrospira platensis C1
MPCNVQDDALVTSLFDTIRDQWGKLDILIHCLAFAGKEELSGDFSTVSREGFTRALDISSYSLVQLSGAAKPLMTSGGSIVTLTYLGGVRVVPNYNVMGIAKAALEMNVRYLAAELGPLGIRVNGISSGPIRTLASSAVGGILDMIHHVEEIAPLKRTVTQTEVGNTAAFLCSDLSSGITGQIIYVDSGYCIMGM

SEQ ID NO: 2075 - protein, 207 aa, Arthrospira platensis C1
MLKFLNQVGDYAKETIQAAKYIGQGLSVTFDHMKRRPITVQYPYEKLIPSERFRGRIHFEFDKCISCEVCVRVCPINLPVVDWEFNRETKKKKLKHYSIDFGVCIFCGNCVEYCPTNCLSMTEEYELAAYDRHELNYDSVALGRLPYKVTDDPMVTPLRELAYLPKGVMDPHDLPPNSRRSGLRPEEILDKMEQQRDGESQAKAEKA

SEQ ID NO: 2076 - protein, 212 aa, Arthrospira platensis NIES-39
MTLRLGDTVPNFTQSSSEGEINFYDWAGDSWVVLFSHPADYTPVCTTELGTVAKLKPEFDKRNVKVIALSVDDADSHKGWIGDINETQQTNINYPILADSDRQVSDLYDMIHPNANASLTVRTVFVIDSNKKLRLTLTYPPSTGRNFSEILRVIDSLQLTDNYSVATPADWQDGEDCVIVPSLKDPEELKQKFPKGYKEIKPYLRMTPQPNK

SEQ ID NO: 2077 - protein, 229 aa, Arthrospira platensis NIES-39
MSVGILGTKLGMTQVFDTETGKAIPVTVVQAGPCTITQVKTEATDGYTAIQLGYGEVPNKTRKLNTRKSPDKEVNKYLSHAEQGHLTKSNSPLVRHLKEYRLESTDNFELGQEVKVDAFEPGQIVDVTGISMGRGFAGNQKRNNFRRGPMAHGSKNHRLPGSIGPGTTPGRVYPGKKMAGRYGGKQITTRKLTIVRVDLERNLLLIKGSIPGKTGGLLNIKPANLVGGK

SEQ ID NO: 2078 - protein, 281 aa, Arthrospira platensis C1
MAGVGMGRYSLGKSPAGMAKALFLFVPWGQQILIHWIKRPDVGGNTIAMSQSQKSVVIAPSILSADFSRLGEEIRAVDEAGADWIHVDVMDGRFVPNITIGPLIVDAIRPVTKKPLDVHLMIVEPEKYVEDFAKAGADIISVHAEHNASPHLHRTLNLIRECGKQSGVVLNPSTPLDLIEYVLDVCDLVLIMSVNPGFGGQKFIPTVVPKIRQLRQMCDERGLDPWIEVDGGLKIDNTWQVLEAGANAIVAGSAVFNADNYSEAIAGIRNSKRPTPELATV

SEQ ID NO: 2079 - protein, 380 aa, Arthrospira platensis C1
MVKVYFRTVTNNNQTYGKGYFVYGNSQTANDQEIVYHTDLREFVYTDPDTQIDLSKGARGTLHFVIGGNPANAVPARSVFNIEMADPVGNLQTTAKEGSQSCRPGQLGLTNKAGIWLEWPSIGDAAPSWWEGKPDGSSSEGEKPTQPSGGSEEPQPTPPNVDWSSFIPPQGGCAPTPPGHIKIKIPYDIGKRDFPNSYLPQVDLSKMNLSGIDLSFSYLCATNLGATNLVAANLGYAYLCHAYLGYANLNYAYLGYANLCCADLSYAVLSQADLSFANLCQAKLIGAQLNQASLAYANFCYAYLGYANLSYSYLGYANFCGADLTNADLQGTDMTGANFTNANLTNADLRGANITGANFSNANLTGAKLDDAQKQLLGIA

SEQ ID NO: 2080 - protein, 358 aa, Arthrospira platensis NIES-39
MVDSLKKPTFEEIRPGVKVPAKETILTPRFYTTDFEEMEKMDISANEEEIRAILEEFRIDYNRHHFVRDEEFEQSWDHIDGETRKVFVEFLERSCTAEFSGFLLYKELSRRLKEKSPVLAECFLLMSRDEARHAGFLNKALSDFNLSLDLGFLTKSRKYTFFKPKFIFYATYLSEKIGYWRYIKIYRHLEAHPEDRIYPIFRFFENWCQDENRHGDFFDAMLKSQPSLLNDWKARLWCRFFLLSVFATMYLNDLQRADFYAAIGLNARDYDIEVIEKTNETAGRVFPIVLNVNHPSFYQRLDHCVKTNEKLSAIANSNAPGFVKFFQKLPHYISNGWQFLNLYLLKPINVEPTHGVAR

SEQ ID NO: 2081 - protein, 392 aa, Arthrospira platensis NIES-39
MTHHQDAIAPHGGKLINRMASAEQRAELLEKADTLPRVQLDERSQSDLELIAIGGFSPLTGFMEQADYSNVVHNMRLSNGLPWSVPITLSVTEEEAAHLSEGSLIRLDSPKGKFVGVLELTQKYTYDKEHEAIHVYRTNDNKHPGVKVVYDQGPVNLAGPVWLLQRESHPLFPNYQIDPADSRSLFREREWKTIVGFQTRNPIHRAHEYIQKCALETVDGLFLHPLVGATKSDDIPADVRMRCYEILMERYYPKNRVILAINPAAMRYAGPREAIFHAMVRKNYGCTHFIVGRDHAGVGDYYGTYDAQHIFDEFEPAELGITPMKFEHAFYCTLTKGMATSKTSPSTPEQRIHLSGTKVREMLRRGELPPPEFSRPEVAAELIKAMRVPSEA

SEQ ID NO: 2082 - protein, 432 aa, Arthrospira platensis NIES-39
MVSTPLQTTKSEEIFSAAQKIMPGGVSSPVRAFKSVGGQPIVFDRVKGAYVWDVDGNQYIDYVGTWGPAICGHAHPEVIAALHEALEKGTSFGAPCALENVLAEMVIDAVPSIEMVRFVNSGTEACMSVLRLMRAFTGREKIIKFEGCYHGHADMFLVKAGSGVATLGLPDSPGVPKNVTVNTLTAPYNDLEAVKKLFSENPGQIAGIILEAVVGNSGFIPPDAGFLEGLRMLTEENGALLVFDEVMTGFRIAYGGAQEKFGVTPDLTTLGKIIGGGLPVGAYGGRQDIMAMVAPAGPMYQAGTLSGNPLAMTAGIKTLELLQKPGTYEYLDQITKKLSNGLLEIAKETGHAACGGQISAMFGFFFTEGPVHNYDHAKKSDLAKFGRFHRGMLERGIYLAPSQFEAGFTSFVHTEEDIDKTLAAAREVLSGL

SEQ ID NO: 2083 - protein, 474 aa, Arthrospira platensis NIES-39
MSEQKFGVIGLAVMGENLALNVERNGFPVAVYNRTSAKTDEFMQKRAPGKNVKPAYTLEEFVASLERPRRILVMVKAGKPVDAVINQLKPLLDHDDMIIDGGNSLYEDTERRTKELEATGLGFMGMGVSGGEEGALWGPSLMPGGTQNSYQALEPILTKIAAQVDDGPCVTYIGAGGAGHYVKMVHNGIEYGDMQLIAEAYDLLRNVIGLNEQQLYEVFAEWNTTDELNSFLIEITADIFKQKDPETGKPLVDLVLDSAGQKGTGRWTVVSALELGVSIPTITAAVNSRIISSYKDERVAASQELPGPSANFDGDVTSFINKVRDALYCSKICSYAQGMALMGKASQEFNYNLNLGEIARIWKGGCIIRAGFLNKIKQAYDQNPQLPNLLLAPEFKHTILDRQSAWREVLVTANTMGIPVPAFSASLDYFDSYRRVSLPQNLTQAQRDYFGAHTYERIDKPRGQFFHTEWANVD

SEQ ID NO: 2084 - protein, 475 aa, Arthrospira platensis NIES-39
MRILFVAAEAAPLAKVGGMGDVVGALPQVLRAMGHDVRVFMPYYGFLPDKIKIPKEPIWWGTAMYQKFAVFETTFPKTDVPLYLFGHPSFMPRRIYYGEDEDWRFTLFANGAAEFCWNYWKPQIVHCHDWHTGMIPVWMKETPDIGTIFTIHNLAYQGPWRWFLERITWCPWFMEGHNVMAAAVQFADRVTTVSPTYASQIQTAGYGENMEGLLSYISGKMSGILNGIDTSSYNPENDRYIVENFNADTVEKRKTNKVALQEELGLEVNSGAFLIGMVTRLVEQKGLDLVIQIMDQFMSFTDSQFILLGTGDRYYETQMWQMASRYPGRMTTQILFNDALSRRIYSGADALIMPSRFEPCGISQMLAMRYGCIPIVRRTGGLVDTVSHNDPVGEGGTGYCFDRYEPLDFFTSMVRASEAFRYKDHWRRLQQRAMHQNFSWENSAREYIKVYEEVAGYYSYQPPTPEAEPETGVTT

SEQ ID NO: 2085 - protein, 530 aa, Arthrospira platensis C1
MSVSYFDTANQLLRKGQLDEAIASYNQAIAASPKSAWYYHNLGEALSQQGKIDEAIAAYRQATELNPNSAWSYDNLGTLLNQQGNLPEAVRCFRQAIELDPYFWQFYHNLALVLIKQGHPEEAVSLLQKAIELTADDAELYHSLGKAYHQQQQYSEAVTAYRQGLELNPYWSDCYMSLGQTLEALGETEEAIASYRRAYELNPNLSEALPKLQTVLESQGRWEELATLYRRCCIVDPNSATSHKYLGTALANSGKLSEAAESYQKALELDPNLVEILQPLGQVLTQLNQWEAAVDIFRKATQVDPNSASFYHQLGQALTKCDRLSEALAAYQKASELHPTSTPVLFDLGQVLTKLYHWSEAIATYQKALYLNPPNQAEIQTHLQEVQDKQRHLDEEIAAYSESHEFHPNSGESYETFGQFLRSKGKIEDAIIGFHQACILNPQSAVAHHQLGYTLARGQRWDEAIIAYQKAGELNPYSPHVQYHLGQALVEEGRLEEAIAHFKQSITIDPEFEEGYDALKQAIAKKKGSL

SEQ ID NO: 2086 - protein, 736 aa, Arthrospira platensis NIES-39
MTATTSKPVSAPEFCQGIQYFSETFPRLETYGQKPAIAEGTVAISDPKDPVAVYQTLLYADALRYLILQVTGSKASGHPGGFASQAEAYAALVMLGYKNIITEVGHHAPGFYSAVFLDRSLEDMEIYTVQQLRDRFREMHGLLGHLSGYIPGLLNPAGPLGQGQHFAMAAALLHRDKLFPFTLGDGGMGEPYPMSSMAHFNTAYPNVTNFLPILVWNGYSQEHHSMVSTKTNEEMIAYWKGNGFKEVLLVDAKDFDDQNQPGDYVDSTAFSIDRRMAFTQAVMETVDKAAKFALNGTLTVFIIKQLKGAGVHARGAKSHNLYPGDTLDSPHMIKALQERSLPVAAWELVRKNIERAGGGPASKTVVTEFEYPIADLGTLPLEEYTVGGDPKVATTAMGAIVGHVGQKDPHFLVTNADGNAASGINNINQALKIIHPTPDDIYFQGPNGQVYEPLSEDACAGMAAGLALMGARTLWCSYESFAINGLPIWQTVTQAMAELRHLTPSTITLFTAGALEQGRNGWTHQRPEIEAYFAAMLRNGNVFALFPPDANSIQVCYQWALNTKNKGITITASKSPLPIRTTFEQTRQGLRDGAVILEEVKGDKTVVFAVIGDMTLIPVFEAAAYLETEGIGTRIVSVINPRRLYRPTDVAWDTCSEADGDFISDELFENLFGGDALIGVTGGASLMLEPIMLRSNIRRDTFAWKRGETTSSAGQLMAFNGLTAETLTKRAIELIH

SEQ ID NO: 2087 - protein, 929 aa, Arthrospira platensis NIES-39
MLKALLGDPNARKIKKYQPVVTDVNILEEDVRSLSDEGLKAKTGEFKEMLAKAQNRGEREQILDEILPLAFAVVREASRRVLGMRHFDVQVLGGMILHKGEIAEMKTGEGKTLVSTLPAYLNGLSGHGVHIITVNDYLARRDAEWMGQVHRFLGLSVGLIQQGMGPEERKKNYSCDITYATNSEVGFDYLRDNMATSMEEVVQRPFNYCIIDEVDSVLIDEARTPLIISGQVERPSEKYMRAAEVAKGLQKDKDHYEVDEKARNVLLTDEGFAAAEEFLGVKDLYDPNDPWAHFVFNALKAKELFIKDVNYIVRDDEVVIVDEFTGRVMQGRRWSDGLHQAIEAKEAVEIQPETQTLATITYQNFFLLYPKLSGMTGTAKTEEAEIEKIYSLQVTVVPTNRPTARADLSDMVYKTEQGKWLAIATECAQMHNMGRPVLVGTTSVEKSELLSGLLSQQEVPHNLLNAKPENVERESEIVAQAGRKGAVTIATNMAGRGTDIILGGNADYMARLKLREYFMPRIVKPQDERELAIPQIGGGPRRNKPQGFAAADKPKVWKVAAGIFPTELSVDTQEKLRSAVDFAVSVYGERSVPELQAEDILAVASEKAPTTDVVVQRIREVYQAIVAEYEVFTHEEHNEVVSLGGLHVIGTERHESRRVDNQLRGRAGRQGDPGSTRFFLSLEDNLLRIFGGERVAAMMTAFQVEEDLPIESKLLTRSLENAQKKVETYYYDIRKQVFEYDEVMNNQRRAIYAERRRVLEGQDLKEQVIKYGEKTMDDIVEAYINPDLPSEEWDLETLVAKVKEFVYLLKDLAAEQLFDMTVEEIKTFLYEQLRNAYDIKEAQVNQIRPGLMRDAERFFILQQIDSLWREHLQQMDALRESVGLRGYGQKDPLVEYKREGYELFLDMMTDIRRNVIYSMFQFQPQPAVA

SEQ ID NO: 2088 - protein, 2483 aa, Arthrospira platensis NIES-39
MDEELFTTVFLEDDELQEISDDFEAETPFLLPIETVDDAAEVEITTTAAPVNPLSDVVNLRDFIIEQLFDEEVYLAQNPDLAQFKLELEAAGFEFNLREHFREFGKFEGREFSAFFSVTRYLEKNTDISLVINREEAFSHFLDFGLNEAREFSDFFSASFYAEANPDLAAITQETLVSKFAHFLGVGQFENRRCSRVFDANNYLQLNPDVSQLLQESANLGLQISAFSHFITRGRSENRQFSNIFDVSEYLQLNPDLVPFVESGEINAIDHWVRFGISERREFSLSFTVSQVLRTLSLSSLTEINISELFAQIESNLALIIESEDDVDDDVDDDVDDDIDDDVDDDVDDDIDDDVDDDIDDDIDDDVDDDIDDDIDATAPEIPQIPPLPVIPPIAEQPEPEPEPEPEPEPEPEPEPEPEPEPEPEPEPEPEPEPEPEPEPEPEPEEPELPLDVVLDVEHILTTYESQLQIAFEVQDVTTISTRELLDWLDENALEAGINPSPFVDIQFYVRTFGQQLTQFYSVTSVEELSYLQIVNFIEGEGLERGFSPSPNINFTHFKATYSSQIEAFFRTSIENITNAQLFSYIVEVGLEQGQSPSVLIDLNFVLSNQQSVTAIESHFGTEIANLTNAQIVRFISSDAGLQRVTPSTLVSLNYFRAVHRTRLEEFFGTEITEISNSQVFTFVNTIGLQEGLNTSAKLGFSYLQSVYGERITAALGEGASQQQVLAFIQREGLPENVNPSVFVHLDFVQQSQSQEVQQFFNVESATELSNQQVINSIKANVLVDVQYVVTQYAEQLAEFYEIEVEEVNSLSSEQVISFSLGAGANLGINPAPINFAETRELFETELRDFFRVSDVTVLSDSQVNSFVINQSRLSGRVNQLVDVVNVNYYQSIFSEALTATFGEDLTEENVVEFVFGDAAPAINTRFAKIKYKAALEQYAQSLGRTLETLTDDEVRLYLFTEGFDVENTLTPFNLEVVTTEYEIQLTAFYGVTNVAVLSEQQIYRFVVNQALEQGLSLAEVVDEEALEVLREEYSSLLIEFYGVENVETLSTNVVLDFIYGGLSRIVDYDYFRFTFTGDVEATFGVESISEVTKLQIVEYLYEQEVSVSSLHWFNVEAYLEEHGSAAETAIAQFFRVSSINELSVTQIRDFALNIGVQQFSIEGALNIEYIRETFNAAIVSSDLAVNAWLESFSFLNVDTAYVQSQLEGLLLDETLTLEQVNEILGTEIDSLDGLTDRHLITLVFNSDFQEIIGDVEIQLFQETLNIDYVRTVFASAIAHTLEVDITAVTGEEVLTVPNEQLDEFLLAQSEQIATELEIDADDVTLEVAQEWFITNSVTTVEGLSVEVDIAYIKYQLQQSLDDEQISLEDINSVLDEPVEEFDELTDEQIVTLGLNVEFQSQFSLEISLVQTELSIGFVVSQFSAELADFFGLSEAEFAAKEFTQEEIIEFFSSTQAQAIAEFLGETVVGGEDNDDLGDDQDIVDESNDDSDDDDQDIVDESNDDSDDDDQDIVDESNDDSDDDDQDDDSDDSPEFAAEDVLAYIEQLMVNVETVTQMEEIDIEFVTYQVGELFQASVFSLEDVNTILETEYESVDELTTEDITTLAFSVEFQEVLGEDFEIELVQSEVNYSYLRASQAEAIAALFSTEENPITVEDVLRGEIEPLTDAEILAAFEENFLTADVGFIRYQVEQLLAETTITIEQVNESLSLEESVEAIVELNDAQIINLVYNQEFQALLMEAEQTIELSAINYEAFIEANAETLIAQFEVDDVTELTLEQVHGFMFSGQVSIQGFVNFDYLRETFISAIASQELPDSTVLDWFNTDFSLININFLNAQFNGFTAEVQTQLLDSLGIELSEAESLSHQQLIQIFYSSEFQAITGIETLQTLAFDWQGYAQANAEALADFYQAFLVPAIPEGQAPNSVVVELSNFTGEQAQVTVTLEEVEGGIQVTVDSVEPIADINGVFFDIEDSSLLDSLSVTGDDVTNSSFSGDVKRVRNTSISPLKFDAGVQIGTPGIGQDDIQSTVFVITADGEELSLDQFVGQEFGVRLTSVQSGGSRSASSKLRGTAEAVFTADGDDVGVIDVSSLSAEQVLNFAFGQGWQSGIDPTEFVEVDFQRQQFAVEIARAYNIDVSEVASLESSLVLDYIYGGLSSQIDFEFYRTKYAASLESTFGMSAENLTRVQILEHAYTVGLEQGFNFVAIDYNAIAAQYPQVFADFFGIPVEEIFNLDLSIIQSFDLGIASELGIDITQFVDIEFFRQQASQQILQNYRIENVFRIDSQQLFEFSLQGNFSTAPTIDLNWAMTQYADILAENLADFDQDGDGNIDNSELFDALTGQLLEAGNETSDIYSFEQYFESEDVQEQVAEFFGVESFEDVTFTQRLEYMFGAGLQAGIDPYSEEFLEANPQMAMEIYLEENSTALIEFAGVRSINQVTFLDVYNFQAINEINAFSGISSIDDIDDIDDIVDDIIDDGDAFSV

SEQ ID NO: 2089 - protein, 72 aa, Arthrospira platensis NIES-39; identical to SEQ ID NO: 550

SEQ ID NO: 2090 - protein, 82 aa, Arthrospira platensis NIES-39; identical to SEQ ID NO: 593

SEQ ID NO: 2091 - protein, 92 aa, Arthrospira platensis C1
MKRYGKKREASYRIVAMDSLSRREGRPLEELGFYNPRTDETRLDTPAIIRRLKQGAQPTRTVRNILQKANVFEQLKSGVIAEPSIPEPVSQS

SEQ ID NO: 2092 - protein, 103 aa, Arthrospira platensis NIES-39; identical to SEQ ID NO: 533

SEQ ID NO: 2093 - protein, 127 aa, Arthrospira platensis C1; identical to SEQ ID NO: 540

SEQ ID NO: 2094 - protein, 144 aa, Arthrospira platensis NIES-39
MALSAGTKAPAFTAKDTNGNTVSLSDFAGKTVVLYFYPKDDTPGCTKEAQSFRDNYENYQSRDMVVLGVSTDDEASHKLFTEKYGLPFQLLADTDGAITKAYDVDGGGYAKRVTYIINGEGVIDHVDDKVNTSTHAQDILAKVN

SEQ ID NO: 2095 - protein, 149 aa, Arthrospira platensis NIES-39
MERTFLAIKPDGVQRGLIGEIIKRFEAKGFTLVGLKMMKASRQLAEQHYDVHKERPFFNDLVSFIISGPLVAMVWEGEGVIASARKIIGATNPLNAEPGTLRGDFGISVGRNLIHGSDAPETAQKEIALWFKDEELVSWEPSLKSWLVE

SEQ ID NO: 2096 - protein, 169 aa, Arthrospira platensis NIES-39
MRDAVTSLIKNYDITGRYLDRDAIDSLKSYFVTGTARVQAAATITANAAELVKQAASQLFGDLPELIRPGGNAYTTRRYAACLRDMDYYLRYATYALVAGDTDVLDERVLQGLRETYNSLGVPIGPTVVGIGILKDLATEKVQAAGIEVGAYLEQPFDHLISELSETDV

SEQ ID NO: 2097 - protein, 176 aa, Arthrospira platensis NIES-39; identical to SEQ ID NO: 514

SEQ ID NO: 2098 - protein, 181 aa, Arthrospira platensis NIES-39
MSVRLYVGNLPKELDRKELQAVFAEEGDTISAKVITDRKTGKCRGFGFVTVQSDDLADQIVEKYNGFMFGDNALKIERAQPRKKNKPESEEGRGSDGATATATATATATATPGAVNQSPTSSPTSAPTKSGGGKKKKSNRNQQGSSNANSSSNPESIQPDPRWANELEKLKQMLSAQASNS

SEQ ID NO: 2099 - protein, 198 aa, Arthrospira platensis C1
MIIPDQAQGMYLGQTATMTSPLKTIYQETIVPKLMEQFKYENIHQVPKVVKVTINRGLGEASQNAKALESSVNELAIITGQKPVVTRAKKAIAGFKIRQGMPVGVMVTLRSDRMYAFMERLIHLALPRIRDFRGISPKSFDGRGNYSLGVKEQLIFPEIDYDRIDQIRGLDISIVTTAQTDEEGRALLKEMGMPFREN

SEQ ID NO: 2100 - protein, 215 aa, Arthrospira platensis C1
MVEELMVEMHLLSVNVDFKYDPIYALGVVTAFDRFMQGYIPEADKLSIWAALIMAQESDPNQYRADATALEAQAATLSVKDLTERAKIAQESSGDDPLQSCFHAIANNPKFKYSRLFAIGLYTLLEKSDVTAAQDSEGLKTILSDFSEALRLPKDKLEKDLDLYRTNLEKVAQARLMVEEMTQAERKKREQRAAQSQTATSGSKNPSKDDQVSDS

SEQ ID NO: 2101 - protein, 212 aa, Arthrospira platensis NIES-39
MKLVIQGKNLEITDAIHEYVQQKIAKAVSHFQQLTNEVDVHLSVARNPRINPRQTAEVTIYANGTVIRAQESSENLYASIDLVADKIARQLRKYKEKRMAKQYQLPKTGEVVAQKPIVDDLIGDRTVKLPEEVVRTKYFAMPPMSIQEALEQLQLIDHDFYMFRNAETDEINVIYQRSHHGGYGVIQPRNGSVPTSNGKTGAELTERASTSP

SEQ ID NO: 2102 - protein, 216 aa, Arthrospira platensis C1
MTATQVSARELFRAAYENRYTWDADFPGYTADITYEHDGKVIHGRAKVGADMKAEVLDVADEAAQKAIHGQLWETAIHRVRRDFESVHGENTFSYGETDETGAVEIIIGGKGEGDRYQLRNNEVCMVHRHIHGVVVTIYTHSSHQTPEGYLSHRYDSVYHDPKTGEQKGEKSDFEDSYTQVGKYQILNQRIIHNPESGRSDRFTFSNIQLLNKATT

SEQ ID NO: 2103 - protein, 238 aa, Arthrospira platensis NIES-39
MTKKVSRRLQELQQKVEDRLYEPLEGLTLLKETATAKFVESVEAHIRLGIDPKYTDQQLRTTVTLPKGTGQEVRVAVLAKGDKVAEAQSAGADLVGSDDLIAEIQKGMLDFDKLIATPDMMPQVAKLGRLLGPKGLMPSPKGGTVTMDLTQAIAEFKAGKLEFRSDRTGIVHVMFGKVSFSAEDLLVNLSALQECIDRNRPSGAKGRYWRSVYVCSTMGPAIQLDINALRDLKIAEAA

SEQ ID NO: 2104 - protein, 241 aa, Arthrospira platensis NIES-39
MTTQSPSPNTTIINPMERPQVTQELSENVILTTVDDLYNWARLSSLWPLLYGTACCFIEFAGLIGSRFDFDRFGLVPRSSPRQADLLITAGTITMKYSPMLVRLYEQMPEPKYVIAMGACTVTGGMFSMDSTTAVRGVDKLIPVDVYIPGCPPRPEAIIDAIIKLRKKIANESFQERGNLQQTHRYYTRSHNLKVVEPILTGEYLESTTRQVPPKQLTEAIGMPVPPALQTEPMKKEEQRG

SEQ ID NO: 2105 - protein, 325 aa, Arthrospira platensis NIES-39
MTLLIVGATGTLGRQIARRALDEGYQVRCLARSYKKAAFLKEWGAELVPGDLCDPETLKPALEGVKVVIDAATARPTDSLSIKDVDWKGKVALIQAAKAAGVERFVFFSFLDAEKYTQVPLLEIKRCTEKFLAESGLKYTILRPCGFLQGLIGQFAIPILDGQSVWVPGVSSPIAYMDTQDIAKITIRALSVPEAENKTFPVVGSRAWTADEIIRLCERLSGKQARVTRTPNSIVRIVRKVTRFFQWSLNISDRLAFVEVLATGQPLKASMDETYQILGMNPEENTTLESYLQEYFGRIMKKLKELEYEREKQKKRKQKRSPFKS

SEQ ID NO: 2106 - protein, 391 aa, Arthrospira platensis C1
MDFGIGFLSNNLMLPILDFFYGIVPSYGLAIVALTLVIRFALYPLNAGSIRNMRRMKVTQPLMKERVDKIQKLYKDDPVKQREEMSRVYKELGNPLAGCFPLLLQMPILFALFATLRGSPFSDVNYAIDLQIFPQEQIEQIQPQIYKSKAQNVYVADGVHSSVQALIDTGNNLAVGQKTQVKFQTAQGESLQSKLDSYENPKVKPHWMVTKGEDKVQIDDEGNLVAVKPGEVTIQASLKGIAADKGFLFIDALGRVGAFDDDGNIHWDIVGMILGFGISLYINQVLSGQNQGSSGNPQQDTVNKITPVLFTGMFFFFPLPAGVLLYMLIANIFQTGQAFILSREPLPENLQKIVEESERQTGKKDKKDKKPGESGRASLPFEPGGHSKKKA

SEQ ID NO: 2107 - protein, 391 aa, Arthrospira platensis NIES-39
MRVLVTGGDGYCGWATALYLSNRGYEVGILDNLVRRHWDQQLGIETLTPIAPIQKRIQRWRELTGKSIDLFMGDINNYSFLINSLREFQPDSIVHFGEQRSAPFSMIDREHAVLTQSNNVMGNLNILYAMREEFPDAHLVKLGTMGEYGTPNIDIEEGYITIEHNGRKDTVPYPKQPGSFYHLSKVHDSHNIHFACKIWGLRATDLNQGVVYGVLTDETGMDELLINRLDYDGIFGTALNRFCIQAAINHPLTVYGKGGQTRAFLDIRDTVRCVELAIANPAEPGHFRVFNQFTEMFSVGDLAMMVKKAGVTLGLDVEIQNIENPRVELEDHYFNAKNTNLLDLGLQPHYLSDSLLDSLLNFAIKYKHRVDKNEILPKVSWRNPGSVYAKS

SEQ ID NO: 2108 - protein, 424 aa, Arthrospira platensis NIES-39
MYIDEIIAGEILDSRGNPTVEAEVILEDGTRGSALVPSGASTGEKEAAELRDGDPKRYGGKGVLKAVENVNNRIAPALVGMDVTQQRLIDLTMIELDGTPNKSQMGANAILAVSLAVARAAANYLGIPLYRYLGGSNACILPVPCMNVINGGVHADNTVDFQEFMIAPHNAPNFAESIRMGVETFHSLKSLLQKKGLSTGIGDEGGFAPNLKSNDEAVECILEAITAAGYKPGEDISICLDPATSELWKDGKYLFFKSDQSTKTPEEMAELWKSWANQYPIISIEDGMGENDWDGWKVLTNSIGDKVELVGDDLFCTNPAILAEGIQAGVANSILIKVNQIGTLTETLDTIELAKKHNYKCFVSHRSGETEDTTISDLVVATSTGKIKTGSGCRGERTAKFNQLLRIERDLGKAAKFAGRAAFV

SEQ ID NO: 2109 - protein, 446 aa, Arthrospira platensis NIES-39
MANVIVIGAQWGDEGKGKVTDLLSKSADVVVRYQGGVNAGHTVVVNGQTFKLHLIPSGILYPDTECIIGSGTVIDPKILIGELDQLQELGISTAKLMIAQTAHVTMPYHRLIDQASEERRGTRKIGTTGRGIGPTYADKSERTGIRVIDLMDSESLRSQLEWTIKYKNVLLEKLYDLPPVDPEAVITEYLGYAERLRPHVVDASLKIDNAVRKRHNILFEGAQGTLLDLDHGTYPYVTSSNPVAGGACVGAGVGPTMIDRVIGVAKAYTTRVGEGPFPTEMVDGIGQVLCDRGAEFGTTTGRQRRCGWFDGVIGRYAVRINGLDCLAITKLDVLDELDEIKVCVAYNLDGERCEDFPSDGRKFARCQPIYETLPGWKKSTAECRDLQDLPQQALDYLKFLAELMEVPIAIVSLGASRDQTIIVEDPIHGPKRALLDAKGQPVEHQS

SEQ ID NO: 2110 - protein, 473 aa, Arthrospira platensis NIES-39
MPTTAQEVLSMIQDQDIKVIDLKFIDMPGTWQHLTVYYDQIDETSFTDGVAFDGSSIRGWKAINESDMMMVLDPTTAWFDPFMAEPTLSVICSIKEPRTGEWYSRCPRVIAQKAVNYLKETGIADTAFLGPEAEFFVFDDVRFDQNQHSGYYFLDSIEGRWNSGREEPGGNLGYKPRYKEGYFPVSPTDTMQDLRTEMLLTMAQCGVPIEKHHHEVATGGQNELGIKFGTLVEAADNLMVYKYVIKNVAKKYGKTVTFMPKPVFNDNGSGMHTHQSLWKDGQPLFAGDGYAGLSQMALHYIGGILKHAPALLALTNPTTNSYKRLVPGFEAPVNLAYSQGNRSASVRIPLAGDSPKAKRFEFRCPDATANPYLAFAAMLCAGIDGIKNEIDPGEPLDVDIYDLTPEELRKIPSTPGSLELALEALENDHAFLTDCGVFTEDFITNWISYKLDNEVNPMRLRPHPFEFSLYYDC

SEQ ID NO: 2111 - protein, 548 aa, Arthrospira platensis NIES-39
MIETSSPLGIGIANLSHLTLAQENSSPNPVDELMNFRMGDISLVDFGAAILILLVGYLVALFAASLVKKLLKKTDIDNKLVSWISGSTEGGEDFPVEKWAGTLVFWVIFIFAIIGFFDRLQLTSVSAPLTTLLNEITRYLPRILGAAGLLAIAWVFATICRTLMIKFLDMFRLDERLNQQVSHGESESHFSLSHTLGNAIYWFIFLLFLPMILSTLELAGLLSPVQTMVNQILSSLPNILKALVIAAGGWLLAQIVSRIVTNLLAAVGFDRLSNQLGLQRAMGTTSLSSVLGTIVYVVLMIPIAISALQALQINAISDPAISMLNQIFNVIPQVFIAGVVLVLAYMFGVIVRDLVTNLLTNLGFNNIFMWLGVESKAIPVATETQTTEEDEVIDDKSVSSPAKQTPSEIVGVIALVGVMFFAVVTATDILGLTALTLIIEQLLIIAGRVLLGVIIFGIGLYFANLAHNLISSSGTSSAKLLAQAARIAIIIFVGAMALQQMGIASDIVNLAFGLLLGAIAVAIAIAFGLGGRDVASEQIREIISRLKQ

SEQ ID NO: 2112 - protein, 596 aa, Arthrospira platensis NIES-39
MSLPIRNVAIIAHVDHGKTTLVDALLKQSGIFREGEDVPDCIMDSNDIERERGITILSKNTAVRYGETLINIVDTPGHADFGGEVERVLGMVDGCILIVDANEGPMPQTRFVLKKALEKGLRPIVVINKIDRPRAEPYGAVDKVLDLFLELGADDDQCEFPYLFASGLAGYAKQDLEEEGVDMKPLFEYIIDHVPPPVGDPEKPLQLQVTTLDYSEYVGRIVIGKIHNGVIRAGQQAALVKENGEVVRSKITKLMGFEGLSRIDLESSSAGNLVAVAGFSDANIGETITCPNEPQALPLIRVDEPTLQMAFSVNDSPFAGQEGTYVTSRQLRDRLMRELETNVALRVEETDSPDKFMVSGRGELHLGILIENMRREGYEFQVSQPQVIYREVSGQPCEPFEYLVLDVPEEAVGSCMERLGQRRAEMQDMRMGVNGRGQLEFVVPARGLVGFRGEFMRMTRGEGIMNHSFLEYRPMSGDIEARRNGVLISFEEGVSTFYALKNAEDRGVFFITPGTKVYKGMIVGEHNRPQDLELNVCKTKQLTNHRSATGDELVQLQTPMDMSLERALEYIGPDELVEVTPESVRLRKVSKKLVKR

SEQ ID NO: 2113 - protein, 720 aa, Arthrospira platensis NIES-39
MQEIDKSISFDGRDIRLKIGLLAPQAGGALLVESGDTSVLVTATRAEGRPGIDFLPLLVDYEERLYAGGRIPGGFLRREGRPPDRVTLTSRLIDRPLRPLIPGWIRDDIQIVATTLSMDEQVPPDVLAVTGASVAVLLARIPFYGPMAAVRVGLVGDDFIINPTYKEIRNGDLDLVVAGSPQGVVMVEAGANELPEHDVIEAIDFGYEAVMDLIKAQTEIMQELNIDNPVEEPLPEDRTLIEFIQERVTEPVKKVLGQFELNKDERDAALDVIKEEQIVSAIASMPEDDPISLFNIENPKAVGMIFKDITKKLMRQQILTDGVRVDGRNLDQVRPVSCRVGLLPKRVHGSGLFNRGLTQVLSIATLGTPGDAQDLDDLHPQDEKRYMHHYNFPPYSVGETRPMRSPGRREIGHGALAERALLPVLPSKEQFPYVIRIVSEVLSSNGSTSMGSVCGSTLALMDAGVPITKPVSGAAMGLIKEGSEVRILTDIQGIEDFLGDMDFKVAGTDSGITALQMDMKITGLSLDVVADAIAKAKPARLHILEKMLEVLPSPRPDLSPFAPRLLTLKIDPDLIGLVIGPGGKTIKGITEETGVKIDIDDDGTVTIASTDSENAARAYQIVQGMTRKLNAGDVYVGKVTRIIPIGAFVEVLPGKEGMIHISQLAEYRVPKVEDEVAVGDEVIVKVREIDPKGRINLTRLKIHPDEAAAAKAAASSGTVQ

SEQ ID NO: 2114 - protein, 748 aa, Arthrospira platensis C1
MSSFEDYNKMTSANPYEINDQQYQGIGVPEESLGSILQRGGEELAITKVPGRFTVRLVSTPPVGGAGVSPLPGQADGLTPKQPVTDSGPQFTPVVSEAENLENLPIHIEETSSVPPELQEVKVKDTELDQAMELARQSDRVAFASHVYQADNNPGMVMYLTNQITIQFNEDVEESNRNAIANSQGLRLLKSVYGVPNTFVYEVIRQAKENPIKIANRLTWNPEVLVAEPNIVVKSQKYYRPSDPLYPRQWYLHNTGGADVAPDAHISVEPAWDITRGTRSIVVAITDDAIDLNHPDFQGIGKIVAPIDLKGQNRLPSPQSPSDNHGTACAGLAIAEENGKGIVGVAPGCALMPIRTTGYLDDESVERIFDWAINNRASVISCSWGASAVSFPLSIRQQAVITKAATVGRNGRGCVVLFAAGNANRPINGTINESGWPNNVISGRVRWLSGFAVHPDVISVSACTSLNKKAAYSNWGTGITVCAPSNNAPPGMWLQETGYIGTPPAIRTALRGLGVFTTDRVGAAGYDQGDFTSHFGGTSAATPLVAGVAALVLSVNPDLSAREVRRIIEQTADKIVDPDADPQLGISMGTYDGNGYSQWFGYGRVNAEKAVKMAQSQRVSRQQVQRRVEQSNNRVLNIPDHNPQGVTSTISVANTSPILDIQVTVDIEHQFLGDLEVRLIPPHGEEVLLQGRTLGGNKVLKTTYNLQTTPYMRELLNHSPQGTWRLVVADLAPHHTGKLNGWKLDLGL

SEQ ID NO: 2115 - protein, 870 aa, Arthrospira platensis NIES-39
MIEAYRQQAAERAQQGIPPLPLTAEQTSELCELLKNPPSGEKEFLMELLRDRIPPGVDEAAYVKAGFLTAIAKREISSPLICPQGAIDLLGTMVGGYNVQSLVSFLKSSDSNIASEAANALSKITLVFDAFNDILALSDINPYAKQVLDAWANAAWFIRNPKVPKAITVTVFKVPGETNTDDLSPAPHATTRPDIPLHALAMLESRMPEGIQTIAQLKQKGYPVAYVGDVVGTGSSRKSAINSVLWHIGEDIPFVPNKRRGGYILGGKIAPIFFNTAEDSGAFPIECDVSKIETGDVITIHPYKGEITNEAGEVISTFTLKPETILDEVRAGGRIPLLIGRSLTDKTREAMGLTPSELFARPAMPEDTGVGFTLAQKMVGKACGLPGVRPGTSCEPIMTTVGSQDTTGPMTRDELKELACLGFSADLTMQSFCHTAAYPKPVDIKTHKQLPDFFATRGGVALRPGDGIIHSWLNRMLLPDTVGTGGDSHTRFPLGISFPAGSGLVAFAAALGAMPLDMPESVLVRFKGQLQPGVTLRDIVNAIPWVAMQQGKLTTGKENKQNVFNGRIMEMEGLPDLKVEQAFELTDATAERSCAGCTIKLGTETISEYLRSNVALMRNMIARGYQDARTLTRRIAKMEQWLANPELMEADPDAEYADILEVNLDEIVEPIVAAPNDPDNVKLMSECAGDKIDEVFIGSCMTNIGHYRAAAKVLEGAGPVKVRLWICPPTRMDEQQLREEGVYGTFAAAGARTEMPGCSLCMGNQARVEDNTTVFSTSTRNFNNRMGKGAQVYLGSAELAAVCALLGRIPTVEEYMEIITQKIDPFAGDLYRYLNFDQIAGFEDEGRVIPIEQMPKIEDVLGIPAGALSN

SEQ ID NO: 2116 - protein, 2135 aa, Arthrospira platensis C1
MGKALALREKWSEAAIELRQAIALDNDWLEPQRELARVLVQLSAWDEAAGVLRGVAEESPEDSQTRHLLGDALSKLERWEEAVEAYRGAIALEPDFVWSHNNLGDALRQLERWEEAAEAYQNAIALKGDFVWSHNNLGDALFKLERWDEAAEAYQNAIALDKDSLILQRNLGKVLVKLSAWEEAVTLWQQVAEKSPNDSEVWHLLGDALSGSERWSEAVAAYQNAIGLNPEFSGSHNNLGDALLKLERWSEAAEAYQNAIGLNPEFFWSHNNLGDALLKLERWSEAVAAYQNAIGLNPEFFWSHNNLGDALLKLERWSEAAEAYQNAIAWRDDLPWSHYNLAEALVKLERWEAAVKAYKRAMEIQPDLPCIYEKLGDALRHQVPPNLEEISQVYYKAIEANPNNLEVYYKALEVNPKDAQMSLKLADAFRSQGQLDQAVTFYKNTLQLTPEDVDIQVLALHRLGSISQNRGHLEEALGLYRRCGELSPGVDSGLAVAAVLEKLGRWTDAVDQYRQVVLEFGECGPASLGLGRALAELERPVEAVVEWRRAVKLGVETPEVHRLLAETLVELGRWSEVVEHWKWLLERYPGAVDWRRRLALALMGLGRWTEAAAQWGEYWRVAPGSGRGRVVDFRPQKKTHGEIDHSQELSITGDLTVEFWLYLRDWPKSWTDIISKFVNDKQNEFCFRLKDDQKGQWYYGKGEAVAKQVNWVPQEDMRLHEWVHVACVRKVGQYGRIYFNGVLRREADWSGESEAAGTEAPVWLMASTQWQLFHDGKLSEVRLWNRARSGDEIREGMCEGLTGEEPGLVGLWHGDESDEGVLVDAVGHHHGRLVMAADAGKERPRVGVCGWELSHNAAGRAYTLAQLYGGFTEVELIGCLYPKYGGQVWEPIRGGEIRCHTIRVEDEGRFIEQALGLVLAHPYEVVHLSKPRIANIILGLLYKLVWGARVIVDIDDEELIFVRASEPVDLRELLESGERLPKWKHLQGKEWTRIAVGLVREFDGVTVSNPALQERYGGVVIRHARDEARFVPSADLKRRSREGFGIAQDKKVVLFFGTPRKHKGLVTTARALGSLGRKDVVFAIIGDFEDGKLKEELQGIPGVDYVFVGNQPFESIPDVVAVGDICVLLQDADFRVSQFQIPAKLSDALGMGLVVLLSETAAVADVIESGAVVPVAEGDLPAVLDRVLSDEAECNKFRVRGRELLAAEFGFGVNGSRLAEVMDEVRSGVGVLSDELNLLLAGFPAVGSVLPKWTKNKIAHKTDRESYALNRLSSIMSFINRDNNELVTQRYVNTPHKKLPITVLIIAWDVGHNPLGRSYMLAEVVERVVSNTLLIGFQFPRYGDDVWEPVRNEKVPVITLPGLNLPEFHVSLQRIAKRIRPDVVIACKSRLPSVELGLMIKEECNCPLIIDIDDYELSFFQNRTELTLSDIEAMPEASVATDIEPYAEIWTRLAQNLARTADEIIVSNIALQFKFGGTIIPHVRDENTCNPDLYDSSEVRGRYGIPLNFKVVLFFGTPRLHKGVDRLAQAINAIADPNFRLVIVGSAPDHNVIEKLDTIAPGRIIYLPTQPFSHIPEILSMADVVCLPQEERHIISNYQLPAKAIDAISMGVPLLVSNTLPLMELVDQGLAKLIDPNDLSGCIEEVVKNSVTDQQYESNLRSRFIQFYSYDAAAQKMRQIIQRSLIVKPWQFVPKTNRIISASTHVLGSAAEISQKQSHEGTDIIVFWKQNDTGIYGRRHDMVIKYLASRQDVRKVIVFDAPISEFELVQKKSSKSEINQDRLIYTMTYEKLLGKHDTEKISYNIFVYPPGKYYIHQVQAGRTHINSGYLFYLQEVFRRESVNTNQAIFWIYPKNYLAPEVIKKFDPAKVVVDVVDDHRSWPNISDIEKSNINKNYHEILALADLVFTNCQQVYLSMKQFAPSDIRLVPNGCDSTIPVTPPKNSRKFDKFCSYPGKIIGYIGNLESKIDLKLLEKLAKKFDDCQIVLIGSAHTNPSVLKLKQYSNIFMPGVIPYSEIGSWVSRFDVGIVPHLNTELTKSMNPLKVFVYLSLNVPVVSMQIDNIDQTSKMLYVAKSHEEFITLVATVLDMKRPSADLSARYLAKNNWEERLGTHVNQLLFETKKHVKNVVDRRRIC

SEQ ID NO: 2117 - protein, 67 aa, Arthrospira platensis
MRVFKVTACVPSQTRIRTQRELQNTYFTKLVPYDNWFREQQRIMKMGGKIVKVELATGKPGTNTGLL

SEQ ID NO: 2118 - protein, 93 aa, Arthrospira platensis NIES-39; identical to SEQ ID NO: 638

SEQ ID NO: 2119 - protein, 103 aa, Arthrospira platensis NIES-39; identical to SEQ ID NO: 532

SEQ ID NO: 2120 - protein, 103 aa, Arthrospira platensis NIES-39; identical to SEQ ID NO: 534

SEQ ID NO: 2121 - protein, 128 aa, Arthrospira platensis C1
MTYAIIETGGKQVRVEPGRFYDVESLPVDQDEKLTIEKVLLVQHDGNVHIGQPLVAGAIIEGTIVRHFRDRKVIVYKMRPKKKTRKKRGHRQEVTRLMIDSITLNGEVLASREQSENPTSEPQAATAE

SEQ ID NO: 2122 - protein, 124 aa, Arthrospira platensis NIES-39; identical to SEQ ID NO: 561

SEQ ID NO: 2123 - protein, 132 aa, Arthrospira platensis NIES-39
MKYFVSRLVALLMVVTVALVGCGNSPDGLTGNYSQDTLAVVNSLRTAIALPEDAPEKPAAQAEARTLINSFASRYRRDPAVSSSSSFTTMRTALNALAGHYSSYPNRPVPDKLKQRLEQEFKQVEAAVKRGA

SEQ ID NO: 2124 - protein, 156 aa, Arthrospira platensis NIES-39
MRLQDAKPKAGSQKRRRRLGRGVSAGQGASCGKGMRGQKSRSGGSTRPGFEGGQNPLYRRLPKLKSFPLINRKQYTTINVGRLDSLSANSEVTLSSLIAAGIITTDRGPLKILGDGELNVALQVKAAAFTQSARSKIEAAGGSCEVLGARNTSPEG

SEQ ID NO: 2125 - protein, 161 aa, Arthrospira platensis C1
MIHSTILLAVEEAATESSLFDFDATLPLMAVQFLILAAILNQIFYKPLGNAIDSRADYIRQNKLSAKERLSKAESLAKQYELELAETRKESQQLIINAQAEAQKIAAREMAAAQQEAQKIREAAYQEIEQNKIEARKGLEQQVDSISRLILDKLLGAGMIG

SEQ ID NO: 2126 - protein, 164 aa, Arthrospira platensis NIES-39
MATLTVWKYNSADGAKNALTKLAELQKQRLIQIEDAAIVFWPQGRKKPKTTQAVDLVGSGAFGGAFWGLLFGLIFFVPVLGMAVGALAGALSGYFTDYGIDDDFIKDVRNQVTEGTSALFLLTSSVTLDKVEEAFKDEEKGELIKSNLTNEQEAKLREDFGADE

SEQ ID NO: 2127 - protein, 156 aa, Spirulina platensis
MSRRRVVQKRPVPPDSRYNSRLVSMMVRRIMRHGKKSVAHNIVYDALATIEERTGSDPLELFEKAVRNATPLVEVKARRVGGATYQVPMEVRSERGTTLALRWLIHFSRTRSGRSMASRLASELMDAANETGSAVRKREETHRMAEANKAFAHYRY

SEQ ID NO: 2128 - protein, 177 aa, Arthrospira platensis C1
MVDVFCHNGLLNRLCFVQIGADFKKTILVMKRYRSILACVLAFVTAFVVGCSSPVAVEPPSYSSIQLEKIQEYKSNIAAIRDRSTTELAGYIQKGDWINIDNFAHGPFGTVLQEMNYVVRNLLPNEQPEARKLSREVFEHLQDMSEAAAKADRQQAAISYQEALKDLDLFLSKFPQV

SEQ ID NO: 2129 - protein, 177 aa, Arthrospira platensis C1
MVNLVLLATEASHEGGFGLNFNLFETNLINLGIIIGLLVYYGRGFLNKILSERRAQIEQAIQEADQRLKEAEKALAEQQENLAQAKAEAERIKASAVERAEVIREQIAARAKADVEQMKLTANQDLEAERSRAIAQLRALAVSQALERAEGQIRERLDENSQQQLVDRSLALLGGGS

SEQ ID NO: 2130 - protein, 240 aa, Arthrospira platensis C1
MVSLGLEDKVIIVTGGARGIGAAIVKLLVEFGAKVASIDVIDGETPPGGLALKADVTKLDSMESAAKEIGEKLGTVYGVVANAGITRDNFFTKLTDEDWDQVIAVNLKGVKNTIQPFIQGMYDQNAGSIVAISSISGDRGNAGQTNYASTKAAVIGMMKSIAREGARFNVRANAIAPGFINTEMTQKIPDKVRDKITAEIPFRRFGEPEDIAWAVAFLLSPVASSYVTGEVLRVNGAHHT

SEQ ID NO: 2131 - protein, 234 aa, Arthrospira platensis C1
MNAKKGIIKRSDLIGRLVLDRQSVEQLGHIEEIAADLNSNQVIGFTTKSGMLPVGGKKRAFSWQQIETIGVDAVLVNKSSDEGNFILPENADSSINHEVWTNAGKKVGVLVDYLIKNDTGTVTNYLFKTDGGLRGILQGVYIMPASAMTSAGSKRVIVSESMVENPPQYTEGLDQKIRQAAEFLQEDLERTLSDLEGLKQEAQKLSKSLERVADQDDREDDSEKVGSKDSSQPQ

SEQ ID NO: 2132 - protein, 241 aa, Arthrospira platensis NIES-39
MRKIIIAGNWKMYKTQAEAQEFLKGFVMELEDTPEEREVVLCVPFTDLGVMSKSLHGSRVRLGAQNVHWEDSGAYTGEISPLMLVEIGVRFVVIGHSERRQYFGETNETVNLRLKAAQNHGLTPILCVGETKEQRDAGETESHIFSQLEEGLVGVDQNNLVIAYEPIWAIGTGDTCESEEANRVIGLIRGKLSNPNVTIQYGGSVKPDNIDEIMAQSEIDGALVGGASLQADSFSRIVNYR

SEQ ID NO: 2133 - protein, 254 aa, Arthrospira platensis C1
MSQPFLTINDNDSLTLSQSLQYLQNSGKLQDFLANILRQYVIDKELQSRDEVNSNAAAIEQAVINFRLERNLSDPQAFQTWLDENRLTYKSFHDQVSNGFKRETLKLAVVKENLEEYFQERKPFLDSVVLSRIVVDDYEMAESLKSKIASGEGSFEALAREYSLTTERRVNGMMGAVSKATLPDTLKSTIEGAKVGQIIGPFEVEGRWCLFRIEEFIDVTLETKGIKKQLQDELFDRWMNEQLKTLTVKMQIGD

SEQ ID NO: 2134 - protein, 288 aa, Arthrospira platensis NIES-39
MSQVVDPTEFQVVFTANGAVIVGSPNQSNRIRGTADAIRIQGGDMADTLTAGDNPNMVIYGFSGNDSIVGGEGGNELYGNQGNDTIYGIAGNNLIYGGQGDDLIYGGDGNSSLSGDKGNDTLVGGSGNDIMRGGDGDDLLIGGDGNDLLFGEKGNDTLQGGPGNDTMYGGQGDDLIQGGDGNDFLAGDKGNDTLTGGAGADTFALTANPNLSRDVITDFNSAEGDVIALRAGAGYNLDSFQTVATAADAGGLGGLVYIQSTGVLLFNGEEVAEFLGSPDITASDFELF

SEQ ID NO: 2135 - protein, 283 aa, Arthrospira platensis NIES-39
MINKILVAVAGRGLCEEMLNMLMDLPSLQQASITLLHVVPSQVTAEGMSVKLEEGGKILAQAVQSVKVDPNRVNPRLKQGDPKDIVCQVADEENADLIIMGSRGLGRLQAVLENSVSQYVFQLTSRPMLLVKDDTYVKKLRRVMVAYNSSPEAQECLKTAIDFVKEIQGGQLIIAHVNKDLSGKSAEDYTATAENDPVLAPAVAQAKQMGVSYRCVTGTGKPGPEICRIAEDLNADLLLLGSPDRRPTVAKSFIDIDRLLGNSLSDYVRVYANCPVLLTRHAG

SEQ ID NO: 2136 - protein, 307 aa, Arthrospira platensis NIES-39
MESLKGRDLLSLADLTVAELHSVLSLGIQLKSGMRKLQRRKVLGLMFSKASTRTRVSFSVAMYQLGGHIIDLNPSVTQVSRGEPLVDTARVLGRYLDAIAIRTFAQKDLETFASYAEIPVINALTDREHPCQVLADLMTVQECFNRMAGLTLTYFGDGANNMAHSLLLGCAMVGMNIRIATPSQYPPNPEIVEQAKAIAAGKTEVIITDDPAEAAKGSHVLYTDVWASMGQESEADDRIPLFMPFQVNESLLAKADDDAIVLHCLPAHRDEEITDGVIEGVRSRVWDQAENRMHAQKALLASLLSDD

SEQ ID NO: 2137 - protein, 329 aa, Arthrospira platensis C1
MSNTDRFAILRRGIGATLRVLLVAVATAGLFLAGDLVLPQSAAAYPFWAQETAPETPREATGRIVCANCHLAAKPTEVEVPQSVLPDTVFKAVVKIPYDTNVQQVLGDGSKGALNVGAVLMLPEGFKIAPADRIPEEIAEEVGGLYFQPYSADQENVVIVGPIPGDQYQEIVFPVLSPDPATDKSIHFGKYAVYAGGNRGRGQLYPAGNASNNTVYKASVGGTITKITQEEYVGYQVTITTAEGDSVVETVPPGPELIVSEGQPVAAGDSLTNNPNVGGFGQDDTEIVLQSSTRIQGLLAFFALVMLTQILLVLKKKQVEKVQAAEMNF

SEQ ID NO: 2138 - protein, 327 aa, Arthrospira platensis NIES-39
MAQTLLFNALRQATDEEMARDPAVLVLGEDVGHYGGSYKVTKDLHKKYGDLRVLDTPIAENSFTGMAVGAAMTGLRPIIEGMNMGFLLLAFNQIANNGGMLRYTSGGNFKMPLVIRGPGGVGRQLGAEHSQRLESYFQAVPGLKIVACSTPYNAKGLLKSAIRDDNPVLFFEHVLLYNLKEDLPEEEYLVPLDQADIVRSGKDVTILTYSRMRHHVMQAVPAMVKQGFDPEVIDLISLKPLDLNTIGESIRKTHRVIIVEECMKTGGIGAELTASINDNFFDELDAPVLRLSSQDIPTPYNGMLERLTIVQPEQILEAVQNMLSHQV

SEQ ID NO: 2139 - protein, 381 aa, Arthrospira platensis NIES-39
MKIAIAKELNVNERRVALIPDVVSRLVKQGLEIYVEAGAGEGSCFSDALYEEAGAQVITDSAKLWGEANILLKVSPPQEEEVGKMAEGAVLIGFLNPLGEPDLIQKLSDRRVTAFSMEMVPRTSRAQSMDALSSQANIAGYKAVLIAAANLPKYFPMLTTAAGTIRPAKVLVLGAGVAGLQAIATARRLGAIVEAFDIRPEVKEQVQSLGAKFVDVTLDEDTVAEGGYAKEISEQAKQHTQEVLTQHVAASDVVITTAQVPGKKAPVLVNANMVAQMKPGSVIVDLAAEQGGNCEGSEPGKNIQKNGVTIMGPINIPGSMPVHASEVYAKNLSALLQLMVTKEGELDLNFADDILDGACVTHGGEIRSQRVKEALGVPVGQ

SEQ ID NO: 2140 - protein, 376 aa, Arthrospira platensis C1
MAGDYYDVLGVSRDADKEEIKRAYRRLARKYHPDVNKEPGAEERFKEINRAYEVLSEPEIRARYDRFGEAGVSGAGAGGYGQDFGDSFADIFESFFSGFGGGMGGPTAARRRTGPTRGDDLRLDLRLEFKEAIFGGEKEIRIRHLETCETCNGTGAKPGTSPKTCSTCGGSGQVRRATRTPFGSFTQVSVCPTCNGTGQMIEEKCVSCGGEGLKEVTKKLKITIPAGVDNGTRLRVSNEGDSGKRGGPAGDLYVFLSVDSTPNFKRDGINILSEVKISYLQAILGCTLEVETVQGTTSLTIPAGTQPNTVLTLENQGVPRLGNPVSRGDHLITILIDIPTRITNEERELLEQLAQIKGERTGKGGLEGFLGNLFQK

SEQ ID NO: 2141 - protein, 406 aa, Arthrospira platensis NIES-39
MTLRVAVVGSGPAGSSAAETLVKAGIETYLFERKLDNAKPCGGAIPLCMVSEFDLPPEIIDRRVRKMKMISPSNREVDINLENENEYIGMCRREVLDGFMRDRAASLGANLINGTVHKLEIPASSGEPYTIHYNDHSSGDAVGTAKTLKVDLVIGADGANSRVAKAIDAGDYNYAIAFQERIRIPADKMAYYEDRAEMYVGNDVSPDFYAWVFPKYDHVAVGTGTMKVNQAMIKKLQAGIRARAAHRIEGGKIIKVEAHPIPEHPRPRRVVGRVALVGDAAGTVTKSSGEGIYFAAKSGRMCAETIVETSNAGQRIPTEDDLKLYLKRWDKQYGMTYLVLDVLQRVFYRSDASREAFVEMCSDLDVQRMTFDSYLYKTVVPANPLVQMKITAKTLGSLLRGHALAP

SEQ ID NO: 2142 - protein, 427 aa, Arthrospira platensis NIES-39
MSDTNLDILAQSDPTVTEFIGQELQRQREHLELIASENFTSAAVLAAQGSVLTNKYAEGLPKKRYYGGCEFIDKIEQIAIDRACELFDATHANVQPHSGAQANFAVFLALLQPGDTIMGMDLSHGGHLTHGSPVNVSGKWFNVCHYGVSPETETLDYDKILELAKQHQPKLMICGYSAYPRIIEFDKFRAIADEVGAYLLADIAHIAGLVATGHHPNPLPHCHVVTTTTHKTLRGPRGGLILTRDPELGKKLDKAVFPGTQGGPLEHVIAGKAVAFGEALKPEFKTYSSQVIANAQALANCLQQRGLKIVSGGTDNHLMLVDLRSVKMTGKIADRLMSEINITANKNTVPFDPESPFVTSGLRLGSPAMTTRGMGTSEFIEIGNIIADRLLNPDDDTVTADCRARVAQLCDRFPLYPHLQIKVPALT

SEQ ID NO: 2143 - protein, 474 aa, Arthrospira platensis NIES-39
MVLSLFGIISPFSMFSSLGVDPVPLLANTIEGISEAPEADGNIVLLAVLLSLVAIYTASKVGGEFFNWLGFPPVLGELVGGVVIGISALHLVVFPEGGVGASDSVIMQILSSTAGLDISAAGATFEAQSEVISVLAEIGVIVLLFEIGLESNIRELLEVGVQSLVVAIVGVVAPFFAGTIGLILLFNVPPVAAIFAGAALTATSIGITSRVLAEIGRLSSKEGQIILGAAVMDDILGIIVLAVVASLAKTGEIDVTNIIFLIISATVFLVGAILLGRFFNDTFVTLAKQFKTRGRIVIPAFILALLLSYIAAAIGLEAILGAFAAGLVLDETEPGKELEELTRPISDVLVPIFFVTVGAKTNLEVLNPAVPDNRQGLVIASFLIVVAIFGKVISGFSVFGVENINRLAIGVGMIPRGEVGLVFAAVGSDSGALSPSLDVAIILMVILTTFVAPPLLRVVFRDDEPTATEPETTA

SEQ ID NO: 2144 - protein, 503 aa, Arthrospira platensis C1
MVLSDVPFLVNNDCENDCEYNRTRRVIVSQGFDYDLVIIGAGVGGHGAAIHAVNCGLKTAIVEADLMGGTCVNRGCIPSKALLAASGRVRELRNAHHLQSLGIQVGAVNFDRQTIANHAENIVTKLRSDLTNSLKRLKVDTFHGWGKVAGPQKVAIATGDGEKIITAKDIILAPGSVPFVPPGIEIDHQTVFTSDDALKLSSLPQWIAIVGSGYIGLEFADIYTALGCEVTMIEALDNLMPTFDPDIAKLAERVLLSSRDVETFSGKLALKVTPGSPVLIELADAKTKQVEQVLEVDACLVATGRIPVSKNMGLETVGVETQRGFIPVDNYLGALSGTKRVPHLWAIGDVTGKMMLAHAASAQGVAVVETICGRDRQVDYLSIPAAAFTHPEISYVGMTEPAAKELGKSQGFEVATVKSYFKGNSKAIAEVDTEGVAKVIYRQDTGELLGVHIFGLHASDLIQEAANAIALRQSVNTLTFLVHTHPTLSEVLDEAYKRAATIG

SEQ ID NO: 2145 - protein, 540 aa, Arthrospira platensis C1
MVNPLQLQFISPTMPKVLVSDPIDQVGLDIISQVAQVDVKTGLPAEELVKIIPEYDALMIRSGTRVTKEIIEAGTQLKIIGRAGVGVDNVDVPAATRQGIVVVNSPQGNTIAAAEHAIAMMLALSRHIPEANVSVKSGQWNRKQFIGVEVYKKTLGIVGLGKIGSHVASAAKAMGMKLLAYDPFISQDRAEQLGCRLVDLDLLIRESDYISLHMPKTEETYHLINAQALAQMKPTARIINCARGGIVDEVALAEALKNDQIAGAAVDVYENEPLEENSPLRELGQKVILTPHLGASTEEAQVNVAIDVAEQIRDVLLGLPARSAVNIPGLYPDALEQLKPYLQLAETLGNLVSQLVGGRVDFLDIRLQGDLANRDSKPVVVAALKGLLSQALRERVNYVNATIEAKERGIRVIETRDASVCDYTGSLHLEAKGSLGTHSVTGALLGDREIRVTNIDDFPINVPPTRYMLFTLHRDMPGIIGKIGSLLGSFNVNIASMQVGRKIVRGEAVMVLSLDDPLPDGLLSEIMKVAGIRDAYTVTL

SEQ ID NO: 2146 - protein, 502 aa, Arthrospira platensis NIES-39
MKSSLVILYHREPYDEVIENGKIHYRAKKSPNGIVPTLKSFFANVNQGTWVAWKQVTAKQKADFQERVEVEDEGNYTVRRIALNADQVKHFYHITSKEAFWPVLHSFPYHFTSETADWENFTTINRLFAEAACEEAADDALIWIHDYNLWLAARYIRELKPDARIAFFHHTPFPSVDVFNILPWRQEIVESLLCCDLVGFHIPRYSENFVNVARSLCEIKVVKREPVAPHLTKVGTALAEPEMVSQLEYKGQIVNIDAFPVGTNPGFIESVLEKPEGQSRLTAINEELGDRKLILAAGRVDYVKGNRQMLEAYERLLERRRDLHGKIQFLMTCVSAADGMRVYKTAQHQIEQLVGKINGRFARLDWMPTLLFTQPIPLPDLFSYYRLADVCWTTPLRDGLNLVAKEYVVAREDRGGVLVLSEFVGAAVELPQAVLANPYSTQRMDEAIEFALAMDPEEQKRRMAEMRKTVVKYDVKYWADHVFERFESMTHQKAAVKTTVAV

SEQ ID NO: 2147 - protein, 707 aa, Arthrospira platensis C1
MPDKKSESQVLIMTGMHRSGTSLTASLLQSAGLHVGRRLMQGTEFNPKGYFENIDFFEFHLDLLRSQGVNIDGWTLQENLDVPDEFIDKANAIVDKNSLSHIWGWKEPRTTLFLDFWAQLLPDAKFLLIYRSPWDVIDSLYRRGDEIFRNQPELAVKYWIFYNQKVLDFYNKYGDKCLLANIETIVKYQDKYVAEINQKFGINLTNPSPAVYDDSLMQTNISEDGQRPSLIDYYFPEAIEMYQELESRGWHPNQTPDLSWNNQIKSSPYMAWAFRDWANYRLSAAENKSLRVELEGTQAKLEETLSQLNPTRDELEETRSQLQETESIVEQFKSQLEQTEGVLEKTHSQLQKTESILQESHNQLTGLRSQFSQVQEELEQAKSQLSQTQWDVMKYQSQLHHTQEELEQAEQQNRELNEYESRLMKTEMMLSQSRLELEQANKTQMRTIAQLHYTQGKLEYSDQYLAELERLEPQLEKTEIQLSQSLLKLNQVEKNHQRTLVQLHQTQGNLETCQLYLAESQQQQTQYKNQLEEWKRLGEESIEQQDEMEKAIAQYQAKLQATEQELESSQHQLQQTQGELQRSQDQQLKIEEELVRLRLERSLNPTGETTKQVEYRFLVWKAWSSYTMGNYDDMVVSLRQSWKFRNDSPSETILDWLRSFEQFSSEKSIPFNSESLTKLPEWQKLMKLVMANKPLIAHEISSSKQTV

SEQ ID NO: 2148 - protein, 750 aa, Arthrospira platensis NIES-39
MSKQIIIAEQHRIAAVFSEDEIQELVVATGNQQVSDIYLGIVENVLPGIDAAFVNIGDPERNGFIHVSDLGPLRLKRSSGSITELLMPQQKVLVQVMKEPTGTKGPRLTGNITLPGRYLVLMPYGRGVNLSRRIRSEAERNRLRALAILIKPSGMGLLVRTEAEGMAEDAILEDLEALQKQWEEVQQEATSTRPPALLNRDNDFIQRVLRDMYSTEVNRIVVDSADGIKRVKQHLVNWSVGKTPQGVLIDHHRERIPILEYFRVNAAIREALRPRVDLPSGGYIIIEPTEALTVIDVNSGSFTRSATSRETVLWTNCEAATEIARQLRLRNIAGVIIVDFIDMDSRRDQLQVLEHFNKVLKADKSRPQIAQLSELGLVELTRKRQGQNIYELFGRSCPTCNGLGHLIHLPGESAADTAEASERFMVGPKGLSSTPGLDTGTRTAAVDNTRRVQANVSSVSSAETVYRDDSEIVSAETDTGGNFPELELLNHPSYQDIGGTSNIRRRRRRRIGDLEPLVREEEGNRGNLRVNSGNTYNETTKTETNTDVAFSGRQELTERFPKSVKSDAIKAIPEPPEVVAVEMTGDEQDVYALMGISPLVLSNQSVKNARNAIVTVRLPGDTPLPLSSILEEETDTAISWAPTLPIPNAVTVPPAENLISQDDQNLVYNHVEDTTDDSEESPEITESIEVIDPSDLTVTDINDVTDPNDDIDDSDYIYPSEDSENLETEGDAENTPVIRRRRRRSSAVSE

SEQ ID NO: 2149 - protein, 763 aa, Arthrospira platensis C1
MVSTVERPTKLTSPTDNSSGSITPEWKGFKQGKWTKEVNVRDFIQKNYSLYEGDSGFLANATERTNNLWDQVKELMAEERKQGILDAETKIPSGITAYGAGYIDRSLEQIVGLQTDKPLKRAIMPYGGIRVVKKSLEAYGYELDPETEKIFTQYRKTHNDGVFDAYTPEILLARHSGLVTGLPDAYGRGRIIGDYRRVALYGVDRLILDKKEQQASLELDAMDSETISRREEICEEIRSLQELKEMAASYGLNIGRPAATAQEAVQWTYFGYLAAVKEQNGAAMSLGRVSNFLDIYFERDLQNGTLTESGAQEIIDHFVMKLRMVRFLRAPEYNQLFSGDPTWVTECIGGMGEDGRPLVTKNSFRFLHTLYTLGAAPEPNLTILWSERLPENFKRYCAKVSIETCSTQYENDDLMRAEYGDDYGIACCVSAMKIGKQMQFFGARANLAKALLYAINGGKDETTGEQIGPSWLPVQGDYLEYDDVAEKFDRCLEWLSRLYVNTLNIIHFMHDKYAYERIELALHDRDVYRTMACGMAGLSVVADAFSAIKYSRVKVIRNDQGLVVDYEIEGDYPKFGNNDDRVDDIAANLVKQFMNKIRQHKTYRNSVPTQSILTITSNVVYGKKTGNTPDGRKAGEPFAPGANPMHARDTQGAIAALASVAKLPYEHSQDGISYTFSIVPQALGKQESDRISNLVGMLDGYFADDGHHINVNVLNRETLVEAMEHPEKYPQLTIRVSGYAVNFIKLTREQQLDVINRTFHSRI

SEQ ID NO: 2150 - protein, 905 aa, Arthrospira platensis NIES-39
MAKERPPLEEMTLRQLRKVASEYSISRYSRMRKAQLLAAIQDIERQRFSSPSQSRTLEAKAEVEVAKFTLGQEEQTDDFLSSVDENLVELGSGYSESRVVMMARDPEWAYAYWDISSQQKEQFRRLGGQQLALRIYDVTGINLSNQSPHSVQEYPCDEMAREWYLPIPVSDRDYVIEIGYRCADGRWLAMARSQAVRIPPIYPSEWIDDQFITVSWGDELKGQTFAQLSPPGLSYGDRIYDDLFNLAKEAEAQRIAGSLFGSMHHVSSFQHGISSYIFPSGVGKWASGVGETMSGVGMSGVGLGVTQSGSALGYSMCVGMSGVGLGVTQSGSALGYSMSGVGMTESGSALGYSMSGVGMSGVGLGYSISGVGMSGVGLGITESGVGLGYSISGVGMSGVGLGYSISGVGMSGVGLGITESGVGLGYSISGVGMSGVGLGYSISGVGMSGVGLGVTESGVGLGYSISGVGMSGVGLGVTESGVGLGYSMSGVGMSGVGLGVTESGVGLGYSMSGVGMSGVGLGLTESGVGMSGVGMGYSMSGVGMTESGSALGYSMSGVGMSGVGMGYSMSGASITESGSALGYSMSGVGMSGVGMGYSMSGVGMTESGSALGYSMSGVGMSGVGMGYSMSGASITESGSALGYSMSGVGMSGVGMGYSMSGASITESGSALGYSMSGVGMSGVGMGYSMSGVGMTESGSALGYSMSGVGMSGVGMGYSMSGASITESGSALGYSMSGVGMSGVGMGYSMSGASITESGSALGYSMSGVGMSGVGMAERMSGIGFTMSGAALGYSMSGIGMSGIGMAASMPPIRPRKFWLVADAELIIYGATEPDAKVSIGGRPIKLNPDGTFRFQMYFPDGQFDYPIMAVAADGEQTRSIHMKFNRETPERHTNTREEAVLEWVG

SEQ ID NO: 2151 - protein, 936 aa, Arthrospira platensis NIES-39
MRIPVATYRIQFNPDFDFEDAQKILPYLQELGISDIYASPIFKARSGSTHGYDVVDPNQINPELGSPETFDELIEEIQERDMGWVQDIVPNHMAYDSENKLLMDVLEHGPDSEYFDYFEIDWDQAYENIKGRVLAPLLGDFYGNCLENGQLKLSYNESGLSVNYYNLKFPLRIESYATLISYKINTLSQTLGNRHPDVIKLLGVLYILKNIPSETSSQQRRDQAEFVKKLLWEIYQENPEIQKFIDENIDFFNGDTGKSESFNLLDNLLSDQFFRLSFWKVGAEELNYRRFFTVNELICVRVEDYKVFQRTHDLIGELVKSGKFTGLRIDHIDGLYNPVQYLRWLREKTGEIYIVVEKILELEEKLPANWPIQGTSGYEFLNYVNGLFCQSKNEERFNQIYAEMTGLTRTYNDLLVAKKRLIADKNLAGDADNLAQLLKRVCGDYRYGRDFTLAGLKTAIMEFLVRFPVYRTYINQEGVGEDDRAYVQQAIREAKVKLPELLNELNLMEKFLFLDYDEFLSEENQQLWLRFVMKLQQFSGPLTAKGIEDTLFYVYYRFLALNEVGGSPSHFGISVEKFHEFNQERLNSWPHAMNATATHDTKRGEDVRSRLNVISELPDQWEERVKVWSQLNRVHKTQIDSKIIPDRNDEYFLYQTLVGSFPFLEEEYPEYVQRIKDYVVKAVREAKVHTAWLRPDTDYENGFVNFVEKILDFSEDNKFWQEFRPFQEKVAFYGMFNSLSQTLLKLISPGLPDIYQGTELWDFSLVDPDNRRPVDFDGRLSYVQEIKRRSRTGMQNLIDDLMATWEDGRLKLFLIARVLQARQEYLDIFQQGDYQPVAVTGKYCDRIMAVARSYGKHTAIAIIPRFLTDIIEPPQFPLGDIWGDTAIIVPEGNGSNWYEAIVNHDIAASPNILVSQILQYFPVGLLINESVPISDK

SEQ ID NO: 2152 - protein, 1077 aa, Arthrospira platensis NIES-39
MPRRNDLKKILLLGSGPIVIGQACEFDYSGTQACKALREEGYDVVLVNSNPATIMTDPETARRTYIEPLTPEIVEKVIEAERPDALLPTMGGQTALNIAVALSKNGVLDKYGVELIGAKLDAIEKAEDRLLFKQAMEKIGVACCPSGIANNLNEARAIAEQIGTYPLIIRPAFTMGGTGGGIAYNQEEYEELAMGGLDASPMSQILVEQSLIGWKEYELEVMRDLADNVVIICSIENLDPMGVHTGDSITVAPAQTLTDKEYQRLRDAAIKIIREIGVETGGSNIQFSVNPVNGDVIVIEMNPRVSRSSALASKATGFPIAKFAAKLSVGYTLDEISNDITKKTPASFEPTIDYVVTKIPRFTFEKFPGAEPVLTTQMKSVGEAMAIGGTFCESFQKAMRSLETGLAGWGLNTNEKVPSLDTIRSGLRTPNPDRMITLRYGMLLGMSVEEIYELTGIDPWFLDKLQQLLETEKFLKRTPVTEINHDDMLAIKRQGFSDRQIAFASQTTEDEVRKYRKGLGVKPAYKMVDTCAAEFESTTPYYYSTYWEEDEMISSDRPKVMILGGGPNRIGQGIEFDYCCCHASYSLRDDGYITIMVNSNPETVSTDYDTSDRLYFEPLTKEDVFNIIEAEEPLGIVIQFGGQTPLKLAVPLEKALSESTLKTKIWGTSPDSIDTAEDRERFEKILRELNIQQAANGMARSYEEALAVAGRIGYPVVVRPSYVLGGRAMEIVYSDEELERYMTFAVLVEPDHPILVDKFLENAVEVDVDAIADHTGNVVIGGIMEHIEQAGIHSGDSACSIPTQTLSETVLATIRRQTIQLAKALNVVGLMNIQFAVQGEQVYILEANPRASRTVPFVSKAIGIPLAKMASRVMSGKTLAELGYTQEKIPDYVSVKEAVLPFAKFPGTDVLLGPEMRSTGEVMGIDTEFGRAFAKAELAAGQVIPMSGTVFVSVNDRDKEAIVPVVQDFLDLGFKVTATINTRKVLWEHGVKVDLELKLHEGRPNVLDAIKNHAVQLAIITPSGSEARADGITIRRSALAYKVPIITTIAGAKATISALRSLQKHPLDVKALQDYYI

SEQ ID NO: 2153 - protein, 1035 aa, Arthrospira platensis NIES-39
MSSLVQSSEPIPSAVVSSNAPVQASDLLLRNRLKIVEDLWESVLRQECGEQLVDLLLQMRSMTSPEGQASPHLQANVWQIIKDLDINAAIRAARAFALYFQLINIVEQHYEQREQELAYAQIKHQGPAESPADKSNRSIFETRHQRFSTAEEAPVELLNQTSRRQDDRDLATFHNLFPMLQRLNVPSQVIQRLLNQLDIRLVFTAHPTEIVRHTIRTKQRRIAKILQQLDTVDESYGKVDNTNPEATGLVKTWTGELQEQLTEEIRLWWRTDELHQFKPTVLDEVEYSLHYFQEILFDVIPQLYQRIKQTLQPHFPHLKPPNYDFCKFGSWVGADRDGNPSVTPEVTWKTACYQRGLIINKYIQAVDHLNQLLSLSLHWSDVLPELLESLDRDQVQLPEVYDQVAIRYRQEPYRLKLCYILKRLENTRDRNQRLSTSNEVERERERIVTKENAGSLYHSGAAFLKELKLIERNLMATGIQCRDLENLICQVEIYGFYLARMDMRQESSVHSTALNEIVDYLQLLARPYDDLTEAERTLWLITELQTRRPLIPAELPFSPKTCETINTFRVMRELQQEFGQEICQTYIISMSHDVSDLLEVLLLAKEAGLYDPATGIGNLQVVPLFETVEDLKKAPSVMKDLFELPLYRAMLAGGYQKYEQVSQDVNASLQEIMLGYSDSNKDSGFLSSNWEIHKAQKALQTLAESYHISIRIFHGRGGSVGRGGGPAYKAILAQPGKSINGRIKITEQGEVLASKYSLSQLALYNLESVATAVIQASLLHTGFDEIEPWNQIMEELSVRSRSCYRALIYEQPDLVDFFEQVTPIQEISQLQISSRPARRQSDKKKDISGLRAIPWVFSWTQSRFLLPSWYGVGTAIEQFIREEPEENIKLLRYFYIKWPFFRTTISKAEMTLAKVDLEMAHHYVRELSHPQDRDRFEDLFQRIAKEFNLTRQMVLEITGQKQLLDNDPVLQRSVRLRNGTIIPLGLLQVSLLQRLRHHGTSATPGVIHSRYSKGELLRGALLTINGIAAGMRNTG

SEQ ID NO: 2154 - protein, 1121 aa, Arthrospira platensis NIES-39
MTASAEYLQEYQKTEAAYTDGKLDEAATLVYKLVEDYPEDPFARLLCGHIYYGLQQYDVAREQYEVVLGLTDDPELVQQAEDYLTEASQFCEDSETGSSLGDISLDDEFDDAQETILEDLSSVGDDANGSLDLDLEEELDLNAIDEQLDELEELTAASQQLGKYPQKPSATIETLDDALDLYDDEDMGMEEIDISSALDDLDELSNLEFEEGTEENLEAIDDVLGDFDISADELEPENLNGKASVGGEELNDSLEDEFALEEDNFNPLELEANPLVDDSNFDLDDEVDPDLTNPLNNPFAQGQETDEEEEDPDLNFDLETSDPFVMDEEDELVLTEGLDPEDPMSGSLEQLPEELFEEDLIDAPHKDSPATNTPGVTQEHQDSWDDLGDDFSLTDLPLTDEPITNETIVDHVALEIKPPDLGDVQDELDIGELELEEDDIFSPLEDMADARHQTVAETNGNGNGKGLVKPDQISLNKTPNNNLDEEEENFSDLNLDEFDQVDDSVSDEFELDDIPDTFDLDSLEESTVSNGTANGAIAHNKTNQTSGSQVNEFLEDFEEFDDVEGFGIPDAAGYAFMPDSADLDDDDLDSNFLGRSSSIPDNDSSAIYEDDVFNTPTEREAITAFSNLSEDSVDTNISVEQGSFAFLENKPLRSKSFYIALGSGLVTLIAVAVATNIATKVAASSYQGEVVNYLRRSGWLMTIVAGASSFGTAFAMGRITSQQLEKATGDLQKQFDAIARGNLNARVNVYAEDELGQMCAKFNYMAQFIESTTREAQRKAEEQEEAKENLQRQVIRLLDDVEGAARGDLTVSAEVTADVLGAVADSFNLTIQNLREIVVQVKQAARQVSRGATDSASFAKDVAGDALRQAEELAATLNSVQLLTDAIQRVADSAKEAEEVARTAAAVATKGGEAVEMTVAGILKIRETVAETTRDVKRLAESSQEISKIVAIISNIASRTNLLALNASIEAARAGEAGRGFAIVADEVRQLADKSAKSLKEIEQIVMQIQSQTSSVMMAMEEGNQQVIEGTRLAEQAKRSLDDIIQVTNRIDVLVRSITADTVEQNETARAVAEVMQAVELSAQDTSQEAQRVASALSNLVGVARDLLTSVERFRVDPSER

SEQ ID NO: 2155 - protein, 2091 aa, Arthrospira platensis NIES-39
MDIAAEGQSPILIITGMHRSGTSLTASLLQEYGVNIGQNLVGSNYGNIKGHFENIDFVEFHKEILRDNGIDELGCVAEDKISLTPTQREQAQQLIAQNQDPLSPWGWKDPRTTLLLDFWGELIPEAKFIFVYRTPWEVVDSLYRRSTDEALITSPEMAVKMWIFYNKKLLNFYKNNPQRCLISNVYKVGNYTKDFIKAINENLGLWLKIDDNRSNFDESLLINKIIKSRKPGLIGYYFPEALSLYQELEEAAKNLGSGLNNFEREAVQQKPSPSWAFKDWSNIRQLEKECGILEADVKLWQDHFHDAVDRLVSKETELGRTQLKLNGLEIKQQDAIAKLVTTEEQLGKTQGELEASTLELRGMTAHAHNLEVGLQEATTKLVATEQELGQTQGELQKIQDKYQDFDIKYQDVLSKLINTETELGTTEFKLHNAQLKISSLETELGQTQFRLQTSQVQFKQAFAKLRELEEELGQTQMARNLAEGELAAIKASKFWKIRSKYATAKRQARRTLKPRFLSSIDNPTNWELLGCRDSYMQVQGWCLHTGKLNLEAVRARVNDEIFEGTYNIERLDVGNIYDYVPGSSNCGFGVQIPLIPGNNRLQLEVKDTRGKWHQFGEYPLRVSPLQAAFDVPNTNIVPVGETLFAGWCCHPQYQITKLFLRYGQQTVECAYGLPRGDVGEIFSDWVGSSNSGWEVLINLPPGTWNISLEAQLENGETVALEKQQPLTVKRVNPLNKVSGKTKQLIKLSAAIRQRAAERKQRLGRLIPMPWEIPTIIRRMSEMYDQTSEIPGEVLLPTGFEIPATIDPYDAWLKANVWTERAADILRNRLAAVPATALPKISVVMPVYNPPIEFLQQAIASVCSQVYSHWELCIADDCSSDPEVAKTLNQLAETEPRIRLHFRSENGNISAATNSAASLATGDFILFLDNDDELTPDALAEIALYLVTNPETDILYSDDDKIDTQGKRFAPQFKPDWSPELLLSYMYMGHALVVRHSLFQELGGFRIGYEGSQDYDFALRATEKARQIGHIPLVLYHWRTAPGSTAVSGAAKPASFQAGQNAIIDAIARRQSAATVHQPQWAVKLNLGIFSHTFPHSGPSVAIIIPTKNQLKLLQACINSLAKTSYQNYQIVVIDNQSDDPQTLAYLASFSDLPKCRVLKISNPETGFSFAHINNRAAEQVEADYLLFLNNDTEIINPDWLSQMMGYGQFEAVGAVGARLIFPNDTIQHAGIIHGLHHGLAGHAFKLTHRDDFGYLAYSKVVKNYSAVTAACLLTPRALFWEMGGFNETDFAVAYNDADYGYRLSEAGYRCVYCPDAELIHREGTSRGFGDNPKEVATFRRRYANQIDPFYSPHLSLANEWFQIQPRRYFGHNLTVKIQPKVLMCSNALEYTGAPLHQLEIAIKLAGDGDIEPVIFSVTDGPLRQVYEQQGIKVIVREHPLTGVYDRQGYGQAISALAEELRLDSYDLVYANTLENFFMVAAAENMGVPCVWNVHESEPWQTYFNRFGGEIAAQALECFHFPYRVIFVADATRNQYLPLNSHHNFITIHNGLDVDRLLTQAEKWTRKSARETLDIDPGEIAILLLGTVCDRKGQQDLVKALPLLPPQWHSRIRCLIVGDRPSLYSSQLANLVNQLPESLRNRASIVSETPDTALYYRAADIFICTSRIESYPRVILEAMGFDLPIITTPVFGIPEQVRCEINALFYTPNQPDELAKCITELLENERKRQQFAQNAKYVLDSLNRFEEMTAAYGEIFQEAYLMNPHPHPQLSQEAPELEVVETETIPETPVPPETVTIEAPQDKNYWETNPTAAIASQWVSNPIVANTIYKRMSGGQSQKYWLRWLIEDYFTQRNFDQLISLGCGIGNHEIVMAQERFANHIDAFDFSEASLNIARQTAANVGVNINFYQDDFNTFTLDKGKKYDIAFCSGSLHHVKEIERFLGIVHGCLHPDGYFIINEYVGDNYCIYSPHQVQIINRLYKCFGEILRSGIQENFINPTIHQVFATDPSEAVRSKLILPFIEYYFNIEVYNPFGGAILHPLYPLLEHTQLLPGDPKSEALVRLLLEFEEILMEIPGGLASDFCLCVLRPKQF

SEQ ID NO: 2156 - protein, 57 aa, Arthrospira platensis C1; identical to SEQ ID NO: 523

SEQ ID NO: 2157 - protein, 71 aa, Arthrospira platensis C1; identical to SEQ ID NO: 647

SEQ ID NO: 2158 - protein, 69 aa, Arthrospira platensis C1; identical to SEQ ID NO: 648

SEQ ID NO: 2159 - protein, 81 aa, Arthrospira platensis NIES-39; identical to SEQ ID NO: 527

SEQ ID NO: 2160 - protein, 77 aa, Arthrospira platensis NIES-39; identical to SEQ ID NO: 644

SEQ ID NO: 2161 - protein, 98 aa, Arthrospira platensis NIES-39; identical to SEQ ID NO: 617

SEQ ID NO: 2162 - protein, 87 aa, Arthrospira platensis Sp-1; identical to SEQ ID NO: 529

SEQ ID NO: 2163 - protein, 104 aa, Arthrospira platensis NIES-39
MSGFIRGLFGRKSEPTETQGSSFYLDPNSAKSLGEIGQPLEVKKSFPKMSGGKPFQAPKATAKPAMEMTQPKASESPAPEVKSDRRRADSSLDMFRNMARDLKK

SEQ ID NO: 2164 - protein, 114 aa, Arthrospira platensis NIES-39
MKKLLSVILLGVALLTFALPRPALAGDVAAGASVFSANCAACHMGGRNVIVANKTLSKSDLAKYLKGFDDDAVAAVAYQVTNGKNAMPGFNGRLSPKQIEDVAAYVVDQAEKGW

SEQ ID NO: 2165 - protein, 107 aa, Arthrospira platensis NIES-39
MSTAVEVTDSTFEQDVLESALPVLVDFWAPWCGPCRMVAPVVEEIAQQYDGQIKVVKLNTDENPQVASQYGIRSIPTLMIFKGGQRVDMVVGAVPKSTLANTLEKYL

SEQ ID NO: 2166 - protein, 105 aa, Spirulina platensis
MATIQQQKIRIRLKAFDRRLLDTSCEKIVDTANRTGATALGPIPLPTKRRIYCVLRSPHVDKDSREHFETRTHRRIIDIYQPSSKTIDALMKLDLPAGVDIEVKL

SEQ ID NO: 2167 - protein, 118 aa, Arthrospira platensis NIES-39; identical to SEQ ID NO: 581

SEQ ID NO: 2168 - protein, 117 aa, Arthrospira platensis NIES-39
MTQGKGFGRDGFGLGKMKELAQAFQKAQAVQEGAKRLQEDLDELEVLGEAGGGLVKVYLSGNQQPRRVEVSPDLLGEDPDVVSDLILTAMKEAYNNSTSIMRERMEELTGGLNLPGL

SEQ ID NO: 2169 - protein, 136 aa, Arthrospira platensis C1
MVEPTKSANPTTASPEGGTMTPTPDQGPNKEQFEEIKEKVVVFLSELPGYVSKFFGEYQKPIVTILLIVVAVVTIKVLFAVVDALNDIPLVAPTFELIGMGYAAWFVYRYLLKASTRQELVQEVNALRKQVFGNKS

SEQ ID NO: 2170 - protein, 133 aa, Arthrospira platensis NIES-39
MATNDTIADMLTRIRNSCMARHQTTEIPSTKMTRSIAKVLQDEGFIANFEEAGAGVKKHLVVSLKYNTKTRTPTIRTLKRVSRPGLRVYKNRKELPRVLGGIGIAIISTSRGVMTDREARLQGLGGEVLCYVW

SEQ ID NO: 2171 - protein, 128 aa, Arthrospira platensis NIES-39; identical to SEQ ID NO: 555

SEQ ID NO: 2172 - protein, 163 aa, Arthrospira platensis C1
MLKRYIWLAVATVFFTFQMWVGNANALELTEELRTLPINAQGDTAVLSLKEIKKGQQVFNAACAQCHALGVTKTNPDVNLSPEALALATPPRDNIAALVDYVKNPTTYDGFIEIYELHPSLKSADIFPKMRNLSEDDLYNVAAYILLQPKVRGEQWGGGKYLR

SEQ ID NO: 2173 - protein, 184 aa, Arthrospira platensis NIES-39
MTSIETPTTLIVTAYNNKNQAKEVLKVLKDMERAGIIFIVNAAVMVKNEKGKVSISETGDTGPRGGAIMGGITAGLIALFNPIGALGVIAMTAGGAGVGALVTHFIDLGFPQEDLKDLSESLTPGSSALIALVEQTWVEKVCEELAKFEGKLYRRAIKEELAAQLTETAKTVEVEPETESESNQ

SEQ ID NO: 2174 - protein, 183 aa, Arthrospira platensis NIES-39
MFRKISLAQVGLVLGGLITVVGFVAYFADYATLNLAGFFYGIPLLLGGLALKAAEIKPIPFSEPTTPEVLSKREQQATPTQNQVRSDVTRYRYGQSAHLIDAIERLKLGGNDDEHPQLQALREGVVDGSYALILEFYSPFVPLSVWEEKQTKIAQFFGPNLRVQVTQPDTDCVDLIMIADTES

SEQ ID NO: 2175 - protein, 206 aa, Arthrospira platensis C1; identical to SEQ ID NO: 490

SEQ ID NO: 2176 - protein, 201 aa, Arthrospira platensis C1
MEITVQCQKRPSGSKPRALRREGLIPAVLYGHKGAESEELTIDAKSAENLMKKGAVNHTLIQLNIPDLSWAGKALLREVQTHPWKGFPYHLSFFSVGTLESVEVTIPLNFIGEPIGVKNSGGMLDLVITEVQVNCKPGNIPEAIDVEVSSLEVGDALHISELQLPEGVEVIAEADQVVASILYRGGGQAEDGEGETEAATA

SEQ ID NO: 2177 - protein, 219 aa, Arthrospira platensis C1; identical to SEQ ID NO: 511

SEQ ID NO: 2178 - protein, 222 aa, Arthrospira platensis NIES-39; identical to SEQ ID NO: 487

SEQ ID NO: 2179 - protein, 297 aa, Arthrospira platensis NIES-39
MVSFGRVMTAMVTPFWEDGSINYPEAERLAAHLADNGSDTLVVCGTTGESPTLTWDEEHELFKVVQQAVAGKAKVIAGTGSNSTQEAIAATQKAAKLGVDGSLQVVPYYNKPPQEGLYQHFLAIASACADLPIVLYNIPGRTGQNLQPETVARLASVPNIVAIKEASGSLDQASQIRQLTPKEFQIYSGDDSLTLPLLAVGGTGVVSVASHLVGKQIQDMIQMFEAGRVQEATEIHIKLFSLFKTLFITTNPIPIKAALKLLGWNVGLSRSPMCEPSPEVIEKVKGVLGELGLIETR

SEQ ID NO: 2180 - protein, 323 aa, Arthrospira platensis NIES-39
MFFPPSCHPTQVSIIGAGKVGGTLAQRIAESNVAHVVLLDVVEGLPQGVALDLMQAGSVEGHDRKILGTNDYADTAGSDVVVITAGRPRTPGMNRNDLIETNAPIVARAVTNAIASSPNAVIIIVTNPLDVMTYIAWQVSQIEPFRIMGMAGVLDSARFQAFIATELNVSVADVNATVMGSHGDLMVPLPRYSTVNGIPITELMDTETINRLIARTRNGGAEIVGLLKTGGAYYAPASSVRTMVESILLNRRRLLPTSAYLKGEYGMKDIFLGVPCWLGCRGVEAVLELNLTDNEREALNSCAQSVREGIEKADAVLAATAAV

SEQ ID NO: 2181 - protein, 307 aa, Arthrospira platensis NIES-39
MEQLFLIIILLFGGSTLAGSVKIINQGDKALVESLGKYNGRTLDPGLNFLVPFYHRVAYKETVREQVLDIPPQKCITRDNVSISVDAVVYWRIMDLEKACYKVNNLQAAMENMVRTQIRSEMGKLELDQTFTARTEVNEMLLRELDIATDPWGVKVTRVELRDICPTKAVMDAMELQMSAERQKRASILASEGERESAVNSAKGRAEAQVLAAEAQQKAVVLEAQAQRQSQVLKAHATAEAIQILTKTLQSDPEAREALQYLLAQNYIEMGATIGNSDSSKVMFMDPRSIPATLEGMKSLISDTPSS

SEQ ID NO: 2182 - protein, 303 aa, Arthrospira platensis C1
MKAQENRRVRKAVITAAGFGTRMFPASKMIKKEFFPIVDAEGIAKPVIQVVVEEAINAGIEEVGIIVQSGDRSLFEDYFQGSPKPEFWRKLSPSSRDYSHYLQTLGERITILTQEQQEGFGHAVFCAAPWVHDEPFMLLLGDHVYASDLEVNCARQLLEVYEKVQQSVIGVRITPGDRIQHYGCVAGTPVKDSDYLFDLTEIYEKPTLNYARTNMRVPGLEWDRFLTIFGLYIIEPKIFDLLADNIRHDVREKGEYQLTSCLQTLLEKEQITGYLVPGRCFDTGLPETYFKTLVEFRNIKTKS

SEQ ID NO: 2183 - protein, 320 aa, Arthrospira platensis NIES-39
MKILALVPGGIGDQILFFPTLDDLKQAYPHAQISVVTEPRAQTAYRVCKSVSKVIPYDFKGRNSLADWGNLIGIVRDREYDVVISLGQRWTVGLLLWLTGIPNRVGYAGSSGEIFLTDAVPLKTEQYAAQMYHDLLQGLDIITPFSGLQINVPKSDLAWADREQESLGVKESGYILIHGGSSQMAINKGIDKIYPVESWQKIIEDIQQRQPNLPVVLVKGPEDQALITQITQRCPQVKLTQPEDIGKLAAMIAAANLMVCTDSAPMHLAIAVGTYTIALFGPTDPHKLLPPSERAIAVKSPTGKMADISPDEVLKRIWGN

SEQ ID NO: 2184 - protein, 314 aa, Arthrospira platensis NIES-39
MAQFKIECIESNISTDRSQYGKFVLGPLDRGQGITVGNALRRVLLSNLEGTAITAVRIAGVNHEFATIDGAREDVLEIMLNLKEAVLKSHTHQKQIGRLLVQGPATVTVGHFDLPSEVEVVDKNQYIATLSPGATLEMECQIEKGTGYRAVDRHRDDSAALDFLQIDAIFMPVRKVNYTVEDARDGGSLEKDRLTLEIWTSGSLTPQEAISQAAAILVDLFGALKDINLESITSDQRDDIDPTSQIPIEELQLSVRAYNCLKRAQINSVADLRDYTEEDLLEIKNFGQKSAEEVIEALQNRLGITLPKERAAKS

SEQ ID NO: 2185 - protein, 312 aa, Arthrospira platensis NIES-39
MRILVTGGAGFIGSHLIDRLMEQKHDVLCLDNFFTGNKDNILKWIGNPYFELIRHDITEPIRLEVDQIYHLACPASPVHYQYNPVKTIKTNVMGTLNMLGLAKRVKARFLLASTSEVYGDPDVHPQTEEYRGNVNCIGPRSCYDEGKRVAETLAFDYYHQNNVDIRVARIFNTFGPRMLENDGRVVSNFIVQAIRGIPLTVYGDGSQTRSFCYVSDLVEGLIRLMNGDYIGPVNLGNPGEYTILELATKIQQMINPDAEIQYKPLPQDDPKQRQPDITKAKKYLDWEPTVHLNDGLKLTIEDFRSRVILESK

SEQ ID NO: 2186 - protein, 342 aa, Arthrospira platensis C1
MQTYENPTVKYDWWAGNARFANLSGLFIAAHVAQSALIAFWAGAFTLFEVSWFDPTLPMGEQGLILLPHLATLGLGVGDGGQVVDTYPFFVVGAVHLISSAVLGAGALFHTFKAPEDLKTAQGQAQKFHFDWEDPKQLGLILGHHLLFLGMGALLLVAKAMYFGGLYDAATQTVRLVTEPTLNPATIYGYQTHFATIDNLEDLVGGHIYVGVMLIAGGVWHILVPPLKWAKKVLIFSGEAILSYSLGGIALAGFVAAYFCAVNTLAYPVEFYGPPLDIKLGIAPYFADTTVLPMGAHTPRCWLANAHFFLAFFFLQGHLWHALRALGFDFRRVERALNSIEV

SEQ ID NO: 2187 - protein, 334 aa, Arthrospira platensis NIES-39
MQFPKFLQKFAILIAVALFCASCDYLPDVSYNPWELVPVATDAKLFDIDFVDNSDHGWIVGSNATLLETQDGGKTWETKQLDLDEPNLLLTSVSFSGSEGWVVGEPSVLLHSTDGGKSWTRIALSNKLPGAPNNIVALGPSAAEMTTNVGAIYQTKDGGQTWQAMVEDAVGVIRSLSRSEQGEYVTVSAKGNFYSTWEPGQTSWTPHIRYSSKRLEKIGFGQDNRLWMLARGGEIRFSDPNDPEEWSDPIKPEFSTSWGLLDLAYRTPEEIWVTGGSGNLLCSFDGGETWQKDRKVEDIPSNFYRIEFMSPKRGFILGQRGTLLRYTGNTSASS

SEQ ID NO: 2188 - protein, 343 aa, Arthrospira platensis NIES-39
MVKERTVPSFQVDSVVITREEGLMLYEDMVLGRLFEDKCAEMYYRGKMFGFVHLYNGQEAVSTGVIRSMRRDEDFVCSTYRDHVHALSAGVTAREVMAELFGKATGCSKGRGGSMHMFSSKHNLLGGFAFVAEGIPVATGAAFQSKYRREVMGDESSDTVTACFFGDGACNNGQFYECLNMATLWKLPILFVVENNKWAIGMAHERATSDPEIYKKGPAFGMPGYEVDGMDVLAVREVAQKAIARARAGEGPTLIEALTYRFRGHSLADPDELRDRDEKEFWFARDPINKFFAYLTEHNLADSDELKAIDKKVQDVINDAVEFAQTSPEPDPSELYRYVYADD

SEQ ID NO: 2189 - protein, 365 aa, Arthrospira platensis C1
MDDKLMLMIPGPTPVPEKALLALAKHPIGHRSGDFSQIMAEVQENLKWLHQTQNDVLILTASGTGAMEAGIINFLKRGDRVLCGCNGKFGDRWAEVATAYGLNVEIISAEWGQPLDPEKFREVLEADTEKQIKAVIITHSETSTGVLNDLETINRHVKNHGEALIIVDAVTSLGAVNLPIDEWGLDVVGSGSQKGYMIPPGLAFVSVSPKAWEAYKTADLPRYYFDLGPYRKTAAKNTNPFTPPVNLFYALQVSLQMMKAEGLENIFARHHRLMTMTRDAVKGLNLPLFAPDHAASPAITAVCPPESIDAEKVRSIMRKQFDIVLAGGQDHLKGKIFRIGHLGFVCDRDILCAIAALETTLQQLN

SEQ ID NO: 2190 - protein, 394 aa, Arthrospira platensis NIES-39
MLGTCKEVDIVIGRGKKARRAYGIDEIALVPGPRTLDPSLADTSWTIGNINREIPIIASAMDSVVDVNMAAKLSQIGALGVLNLEGIQTRYEDPNPILDRIVSVGKTEFVTLMQELYAEPIKPELIKKRIAEIKAQGGIAAVSATPAGASKYGDAVAKAGADLFFVQATVVSTAFLSPESVTPLDLAEFCKNMPIPVVLGNCVTYEVALNLMKAGAVGILVGIGPGAACTSRGVLGVGVPQATAVADCAAARDQFYQETGRYVSVIADGGLITGGDICKCIACGADGVMIGSPFARAEESPGRGFHWGMATPSPVLPRGTRIQVGSTGTLEQILRGPAQLDDGTHNLLGALKTSMGTLGAKTIKEMQQVEVVIAPSLLTEGKVYQKAQQLGMGK

SEQ ID NO: 2191 - protein, 396 aa, Arthrospira platensis NIES-39
MTEVYIVSATRTPLGRFGGGLSGFSPADLGAHAMKAALAKAGVSGENLDLYIFGNVLRAGHGQLIPRQAALKAGIPATVDGYAIDMVCSSAMMSLINGCYTIKAGEADLVLAGGTECMSQTGFFLSHRARWGYKFLMGAPEQLMDILLYDGLTDSTTGDGMGDETERLAAEHGFSRQALDEVAFYSQKRAAEATEKGLFKNEISPIEVSSRKGTQVIDTDEGIRAETTLESLAKLRPAFQKDGVLTAGNSSQISDGAAAIILASEAAVQKYGLKPLAKVLGGAWAGGESWRFPEVPILATQKLLGRLKMSVNDFDLFENNEAFAVSTLLFDTMLGVSQDKLNVNGGAIALGHPIGASGSRIVVTLLNALEQHDKSLGLAALCHGTGGGTAFAIERV

SEQ ID NO: 2192 - protein, 424 aa, Arthrospira platensis C1
MIHEVFMPALSSTMTEGKIVSWQKSPGDRVGKGETVLIVESDKADMDVEAFYEGFLATIIVPEGGTAGVGQTIALIAETEAEIEEAKKQATATAPTPSPEATPTPSVGTPEPVAATVAIDSTPSRRNGRIVATPRARKLAKQLNVDLNNLQGSGPHGRIVAEDVEAATGRTQTPTVAPQPTVSPVAPPTPIATPAPAPVPLGEVVGMNTLQNAVVRNMLASLQVPTFHVGYTITTDNLDKLYKQVKSKGVTMTALLAKAVAVAIQKYPIVNASYVDSGIQYNKAINIAVAVAMPDGGLITPVLSNADQIDIYSLSRTWKDLVARARSKQLQPQEYSSGTFTLSNLGMFGVDRFDAILPPGQGSILAIGASRPTVVATDDGMMGIKPQMQVNITCDHRIIYGADAAAFLQYLAQLIETNPQSLTL

SEQ ID NO: 2193 - protein, 422 aa, Arthrospira platensis NIES-39
MGERAIDPPPISFFGAEIPPGLKISRDCEDLSPSNVILIRGIAAVLNAKYMNPGIDIQGSFIQVLLDLGIPTGVAKILWMPFPMGLMLVGATVGVLGSVWLERKISAAAQQRIGPEYIGPMGSLAPLADGLKLLLKEDIVPFKADPLLFTLGPIIVSIPVFLSYLIVPFGQNLAIANLGTAIFLWIALSSIQPIGLLMSGYASNNKYSLLGGLRAAAQSISYEIPLALAVLAVVMMSNSLSTLDIVQQQSGYGILGWNVWRQPVGFVIFCIAALAECERLPFDLPEAEEELIAGYQTEYSGMKFALYYLASYVNLVLSALLVSVLYLGGWNFPIPVEAIAGLLGVSETTPWLQVLTASLGITMTILKAYLLVFTAILIRWTVPRVRIDQLLNLGWKFLLPVALVNLLLTAALKLAFPIAFGG

SEQ ID NO: 2194 - protein, 463 aa, Arthrospira platensis NIES-39
MRKQRSLLFLILLLVITSLIILVRVPIRLGLDLRGGSQLTIQLQTSDEVPRIDERVLEGVQSVIENRVNGLGVSEAVVQTVGEDQILVQLPGVSDPEQAERVLGGTAQLDFREQRPGTEGELFAEIQVNRALDAELRQAIATGDDARLEELLQQLNESNQAIASLYQEPIIRGQQLQDAFPQPTQGGNGWEIVLRFNNEGGRNFAELTKNLAGTGRTIGIFLDDSLLSSPTVSVEFADTGITGGSAVITGNFTAAEANDLAVQLRGGALPVPVEIVENRTVGATLGRDSIQRSIYAGSGGLILVLIFMVAYYRLPGAIADVALVVYALFTLAIFALLGVTLTLPGIAGFILSIGMAVDANVLIFERTREELRAGKTLYRSVESGFYRAFGSILDGNVTTGIACVALFWLGTGLVKGFALTLGLGVAVSMFTAVTFSRTLMFTVISLPEFRKPELFCPNIPKTN

SEQ ID NO: 2195 - protein, 454 aa, Arthrospira platensis C1
MLNVKPMSIRGIDVSDYQPNVDWKAVANSGMEFAVIKSTEGATFVADVFAPYWKATKANGLIRGAYHFFRPASNIQGQIDNFLRTVPLEPGDLPPVLDIETTDGLDSKTICDRAAVWLEAIEAATGYQPIIYTYPGFWQQLNTDRFSEYPLWIAHYTQAEKPAIPGKWKTWVFWQYTDRGQVDGIRGGVDINIFESIRRGERGPKVELMQTMLKKRGFEPGVIDGIFGAGTERAVISFQDNKGIKEKNGVAGLKTWTALMGQVENFVPPRVEAEPTPEPTPAPAPEPAPEPAPEPAPEPAPAPAPAPAPTPTLELIDICRIYRGSATEDKALVWLQERIPSETLLEFARLWRNQAIPQTQSIRIIDVCRYYRDLPNQNQALRWLQREIPATILLEFEQKWNATPEVVVDIRLLDVCQFYSGTATQKEAIEWLQTQIPAPTMVEFARLWRRPSSR

SEQ ID NO: 2196 - protein, 496 aa, Arthrospira platensis NIES-39
MLKRQKSRTRSYRQFAEVVGSAPQPTSSIFQPQRPRWLSPSLLGCIPLTALIITFWSLAAVAQEDAQPITPEYVQGVLNTIWIVIASILVIFMNAGFGMLETGFCRHKNAVNILAKNLIVFAIATLIYWFFGFSVMFGGENPFIGGGGFFLTGDPSVYGLDPFPEGLPKEVFFLFQVAFAGTAATIVSGAVAERIEFVAFLLFSLLLVGISYPITGHWVWTDNGWLASMDFHDFAGSTVVHSVGGWSALMGAAFLGPRMGKYGPSGEPRAIPGHNMSIATLGCLILWIGWFGFNPGSELAANENVPYIALTTNLAAAAGGVSATLTSWIKDGKPDLSMIINGILAGLVGITAGCDAVPLWAAVVIGAIAGVIVVYSVAFFDRIQIDDPVGATSVHLVCGIWGTLAVGIFGGANLGIQILGILSIGGFTVVMTSIFWLAIKALVGIRVTPEHEYEGLDIAEHGMEAYNGFLKEVGPASVGGIDPGIPSREDGISRSY

SEQ ID NO: 2197 - protein, 531 aa, Arthrospira platensis NIES-39
MAAFFFPEVHRKSDFIWSGVGLFYALILWVCVARFTGAILLGQTASVALLGWLGWQTLLLRREVTPAHLQTPLPTPVKQKVSGLFSSRSVKKSTTPKPSSKKAKKASEPPTPAATPVTPEEVKPLTEPVAEPVAEPVAEPVAEPVAEPVAEPVAEPVATTEEAEAPAEPSPVVAETEAVAPVVEPETITEEPELAVSELEVAEVAPEPTTTAEAETPTAEEVSETVSETVSEEVSKAEETPTEEVTETPEVTKPEPVESAKVPEDQPSEPKKSKGLGGLLAGLKGIFGDRKKKEPAKTKAPDTSKDNPKAPETQGDASDWDDNDESWETDTDNASPSEAEKTNSPDTPEAGQVSTPDIESDHSGATADPVSTVEPIDEEPTDEEHQDSNVKADATNVETVPSVEPTDGEHQDGNIKAEAEPTATDTPETEAETVVSPVADSEEVRTDSAEKSPSETIIGTPEPEASDSPETSESLESEKSSTETEEEKGTQSESDSDSGVAEDEDDEDDDEDEDDKTPRALKRPRKPKRKR

SEQ ID NO: 2198 - protein, 557 aa, Arthrospira platensis C1
MEEFKLMSNLTGTSFIDVNRTGVFDPGDLPIANAAVFTDLPPFDGIYQPDQGERSAITGQDGSFAIDLQGLQAGTEFQLQQIPPADGSVSSPGNNLPLPFTVPADPTQNIGPVAIANLPPDVPVPSVPPITSKGNIQGRTFVDNNVNGRFDSGEPVIGGIPLFLDLDGNGVWTANEPITVSRPDGSFSFNNLTPGTYQLQPLLPGNDVPPGLGGVTPFADRLVATSVSVSPSSLDDRLGGFLGGIARRFLGSDRTEQLAQATNEPNAPELVTVSAGAVTSQDLGFVVPGSIYGFVVSDANSNGVADPGEAGIPGITVSGGGRTAVTDANGFYILDVDARFPTFSDAELAQNPYLHYVLSNEPGLLTESFAVEVVNPPGNLVATGPDPDFDVALGRGQAAQKDFFFNVPPAPVGGPGVPDSITGFVFTDVNIDSAYQVGEPLLEGVTVYLDLDKDGQLNSGPLRDPVTGAVILDENGNPFPAEPSTVTGPGGNFGFFNVSRWLPFIEPGDVEFQVRVEAPASLPFVTTPDVSISGEGLGVLAEVGASGVAFGMSQFPV

SEQ ID NO: 2199 - protein, 528 aa, Arthrospira platensis NIES-39
MDAITLWQRYQDWLYYHEEIGLYLDISRIRFDQAFLEAMKPKFDGAFRDMEALEGGAIANPDEQRMVGHYWLRNPELAPTPQIKQQIIDTVNKIETFVAKVHKGEIKPPQAEKFTDLLSIGIGGSALGPQFVADALAPDYPLINIHFIDNSDPDGIDRILQRLGDRLKSTLILVISKSGGTPEPRNGMMEVKQALLNQNLHFRDQAIATTQIGSKLYQEATSQGWLETFPMEDWIGGRTSEMSAVGLLPAALQGIDIHALLQGAKTMDIATRQPDIKTNPAALLALSWYAVGGGRGQKDMVILPYKDRLILLSRYLQQLVMESLGKEKDLEGNIVNQGISVYGNKGSTDQHAYVQQLRDGVPNFFATFIEVLRDRQKPSPEIEPGVTAGDYLSGFLQGTREALYDNQRDSITVTITEVNPYTVGALVALYERAVSLYASLVNINAYHQPGVEAGKKAAAQVLELQHQGLQVLRGHSQGISISDLAAKIDAQEQVETLYKILRHLAANDRGVELSGDPSKPAQLIAKWR

SEQ ID NO: 2200 - protein, 551 aa, Arthrospira platensis NIES-39
MVANNISPLAGKTAPGDILENIDRLIEQYYSVRPDPNNPQQQVSFGTSGHRGCSANGTFNEDHILAVTQATVEYRRDQGITGPLYMGIDSHALSEPAQKTALEVLAANQVETYIATDKGNGRFTPTPAVSHAILTYNRQRTEGLADGIIVTPSHNPPSDGGFKYNPPSGGPAGPEITKWIQQRANQILADGNRAVSRSPYNQALYASTTHTFDFITPYIADLENIIDMAAIRESGIKIGVDPLGGSNIGYWEPIAERYGLNLTIVNPTVDPTFGFMTVDWDGKIRMDCSSPYAMANLVKLKDDYDIAFGNDTDSDRHGIVTPSMGLMNPNHFLSVAIWYLFTNRQGWSPESAIGKTLVSSSLIDRVAKDINRRLCEVPVGFKWFVDGLLDGSLGFGGEESAGASFLRMDGTVWTTDKDGIIMDLLAAEITAKTGKDPGMHYKDMTERLGRAYYSRIDSAANSEQKARLSKLSPEDVKASTLAGDPIVAKMTNAPGNNAAIGGLKVTTEQGWFAARPSGTEDVYKIYAESFKGEEHLNQIISEAQKIVSDTF

SEQ ID NO: 2201 - protein, 612 aa, Arthrospira platensis NIES-39
MQLQTKIAAGRATGAFALIDSLKRHGVQHIFGYPGGAILPIYDELYRAEAEGGIQHILVRHEQGASHAADGYARATGRVGVCFGTSGPGATNLVTGIATAHMDSIPMVIITGQVARPAIGTDAFQETDIFGITLPIVKHSYVVREPGDMARIVAEAFHIASTGRRGPVLIDVPKDVGLEEFDYIPVNPGEVSLPGYRPTVKGNVRQINQAIKLIEEAERPLMYVGGGAISAGAHAEISELAELFQIPVTTTLMGKGSFDEKHPLSVGMLGMHGTAYANFAVSECDLLIAVGARFDDRVTGKLDEFASRAKVIHIDIDPAEVGKNRTPEVPIVGDVRQVLIDLLRRCREIGDVGNDNQTQSWLERINRWREDYPLVVPSYSDSLSPQEVIAELGKMAPDAYYTTDVGQHQMWAAQFLKNGPRQWISSAGLGTMGYGIPSAMGAKVALSDREVICIAGDASVQMNIQELATIAQYGINVKTVIINNGWQGMVRQWQQAFYGERYSASNMEIGMPDFEMLARSYGVKGMVVKSRDELHQALAEMLAYEGPVLMDVHVTKDENCYPMVAPGKSNAQMIGLPERRQLEKAVELIYCSNCGAKNVASNNFCPECGTKL

SEQ ID NO: 2202 - protein, 655 aa, Arthrospira platensis NIES-39
MSQPTIESILHEKRLFNPSEDFSKQARIKSMEEYRELYEKAKANPEAFWAELAENELHWFKKWDQVLDWQPPFAKWFVGGKINISYNCLDRHLTTWRKNKAALIWEGEPGDSRTLTYSQLHREVCQMANVIKQLGVKKGDRVGIYMPMIPEAAIAMLACARIGAPHTVIFGGFSAEALKDRLEDAEAKLVITADGGWRKDAIVPLKEQVDKALQAGAPSVDNVLVVQRTEQKIQMEPGRDHWWHDLQQNASGQCPAEEMDSEDMLFILYTSGTTGKPKGVVHTTGGYNLYSHITNQWAFDLQDTDVYWCTADVGWITGHSYIVYGPLSNGATTLMYEGAPRASNPGCLWDVVEKYGVTIFYTAPTAIRALMKMGERHPNARDLSSLRILGTVGEPINPEAWIWYNRVIGQGKCPIVDTWWQTETGGFMITPLPGATPTKPGSATLPFPGIIADVVDTEGEPVTNNSGGYLVVRHPWPGMMRTVYGDPERFRRTYWEYLRPKNGDYVYFAGDGAHRDEDGYFWVMGRVDDVINVSGHRLGTMEVESALVSHPAVAEAAVVGRPDEVKGEEIVAFVTLEGDRQPDEALEKELKQHVVNEIGALARPGEIRFSDDLPKTRSGKIMRRLLRSLASGQEISGDTSTLQDRTVLEKLRGGA

SEQ ID NO: 2203 - protein, 666 aa, Arthrospira platensis NIES-39
MTSPTFTKSAQKLSKLEAIKERSNQLREPLATELLNDRNYLTEDAVQILKFHGSYQQDNRDNRVPGQEKDYQFMLRTRSPGGFIPPELYQTLDHLADEYGNGTLRTTTRQGFQLHGILKKNLKTVLSSIIKSMGSTLGACGDLNRNVMAPPAPYCDRPEYEYAKTYANYIADLLTPQTGAYYEIWLDGEKIVSAEENPEVKAARDRNGNGTIFHEGEEPIYGKHYMPRKFKCAVTVPGDNSVDIYTQDVGLVVITNAAGELEGFNVLAGGGMGRTHRKEETFPRIADEIGYVDRADIYDLMKAIVATQRDYGDRTNRRHARMKYLIEDWGVDKFRAQVEDYFGKPLKPFKPLPPWKYQDYLGWHEQGDGKLFLGISVENGRVKDDGSFRLKAALQKIHQKFELPMLITGNHNIILYEISPKHQQQIDRLLKEHGVLPETEIDPLVRYAMACPAFPTCGLAIAESERAIPSILDRIRVLLDKVGLEQEHFVVRMTGCPNGCARPYMAELGFVGSAPDTYQVWLGGSPNQTRLAEPFMERLALCDLEAVLEPIFVGFKQNRQPSESFGDFCHRVGLDSIRTFVSNYQVNSSMNIETKEIPVPTSPETLSNDATAPQAPVDPSKIRHRVSVRHDIYSQLKDESKRQSKPIVEIATQAIEEYLAKVRAES

SEQ ID NO: 2204 - protein, 661 aa, Arthrospira platensis NIES-39
MTVLEQGTITIHTENIFPIIKKSLYTDHEVFLRELVSNAVDAIAKLKMVARTGEYSGDISNPEITIAIDKDAKTLSVSDTGIGLTADEIKKYINQVAFSSAEEFIQKYQATDGESIIGHFGLGFYSSFMVAKQVEIDTLSYKEGAEAVHWTCDGSPEFKLEDSARTTRGTTVTLTLMDDELEYLETSRIQQLIKTYCDFMPVPIIMDGETINRHTAPWRESPNNLTKEDYLDLYRYLYPFQEEPLLWVHLNTDYPFIVNGILYFPKLRPDVDVTQGNIKLFCNQVFVSDHCEEIIPKFLMPLRGVIDSTDIPLNISRSALQTNRTVRKIADYIAKKVGDRLKEVYRDNRQEYIRCWQDVGTFIKFGSLNDDKFKKQVEEILIFRSTYKPPTESGEAQTPEVQVQSEDGDVWEEVKTEKSFSTDEQGRYYTTLSEYLERNKSRHENRVFYCTDEAAQSTYIELHKSQGLEVLFLDSFIDTHFISFLEREHSEVKFLRVDSELDETLIEKDKPAEIVDPKTNKTRSEQIKELFEKSLNKPRVNIRTESLKSEDTPPAMVLLPEAMRRLQDMTALLQQQKADFPEDHILLVNTAHPLIQNLTNLSQGSIIQAGGSSPSEELAKMICHHVYDLALMAQKGFDAEGMKDFVERSNHVLTRLTERAM

SEQ ID NO: 2205 - protein, 760 aa, Arthrospira platensis NIES-39
MTSEIYTQTRLETATLGYPRIGKSRELKKALEAFWRGKSDAETLIQTRNEVEFKNWETQLHAGIDRIGIGDMSLYDHVLDWSIRLGIIPERFASFSGLDRYFAMARGFDGIRALEMTKWFDTNYHYLVPEIPETLQPPDFSDFLETVQRAQTLLGDRAVPMVLGPVTLLRLSRFEMNQDQAGKQLGDRYLLLLQELQKMGVAEVQIHEPALVLGDAANFKQLYQSTYQSLSQVGLPIHLITYFDDLGDNYPWVMELPVAGISLDFTRGRNLELLQQYGFPDDKELGAGIIDARNVWKIRPDSVLSTLEAISRVTPNLRIQPSASLQFVPYDAQRETKLPEPLRSVLSFAEQKLVEITLLADWADRSYGTQEPDKYLEVIRSQWQTFQEFSPVNQGVKERLQNLTSQDLERTLPYEQRQERQPVLPPFPTTTIGSFPQTSEVRQLRVKLKRGDITQAEYEAAIDAEIAKCIQFQEEAGLDVLVHGEFERTDMVEFFGVQLSGFAFSEHGWVQSYGSRCVRPPIIYGDVARTGPMTVREFKVAKSLTDKIVKGMLTGPVTMINWSFTRTDIPRSEQAMQIALALRDEVADLEAAGAKMVQIDEPALREGLPLKPERWDEYLSWAVDAFRLSAAIAKPQTQIHTHMCYSEFGDIIEHIERLDADVLSIENSRSNNETLFEITDAGYKHQVGNGVYDVHSPAVPSTQEMVQQLKTGVANLPVQQIWVNPDCGLKTRGWEEVIPSLKNMVEAAKILRQEANLTEK

SEQ ID NO: 2206 - protein, 972 aa, Arthrospira platensis NIES-39
MTMTHDPRQDIHHLQGLTPPEVETSRQTHGSNVMTPPPREPAWRQFLGKFDDPVIRILIIAAAIAISLGIVNGNYVEGIGIIVAIALATTLAFLNEYKANQEFDILNRMNDEVPIKVIRDHSFTTIPKKDIVVGDLVIIELGDEIPADGQLIEAVSLRVNEASLTGESEAVKKLASSELVASAELPDSAYPRDRLLRGTVVTDGHGTFQVTAVGDRTEIGQTAKLVCEITNIDTPLKQQLDRLSRLIGVLGLAIAVLIDIALVVRGIVTGNLNLSLGQWYIVALAVSSLIIILVRVWLPIVYDGLEISGSQATVPEWLEDDHAIGWVKSSLIGLLIFGVGIAIGYGGNFIPRNLSDWIPASAATEFVTYFMIAVAVIVVAVPEGLALSVTLSLAYSMRKMTKQNNLVRRMHACETIGAATVICSDKTGTLTMNKMQVQEINFPSFSNNIPSDLLTEAIAANSTANLEQHENQKSKAIGNPTEAALLLWLEQNQIDYLSERNRFEIKQQLAFTPDRKYMATLGRSPIDNQEIMHIKGAPDIVLGHCYSYLSENGVISLTKETRRLISQELKNCDAGGMRTLGFAYIPQPQLEGDDLNVEDRQDVVWLGFVAIADPVRPEVPEAVRQCRQAGIDIKMITGDSLLTAAQIGSQIGIIDENDTSEAYITGSQLRDMDDELASKTLKKVRVIGRARPQDKQRIVQLLQAQGEVVAVTGDGTNDAAALNQAQVGLAMGSGTFVAKEASDIILLDDSFRSVKQAVLWGRSLYQNIQKFILFQLTINVVACIIALLGPFIGINLPFTVIQLLWVNLIMDTFAALALATEPPTERVMEVPPRNPQDFIISKAMSSSIFTVGAAFLVILVGFLLYIQSDDQVTAYELSLFFTSFVMLQFWNLFNAKCFGSKDSVLSQLWQNPSFLAIAGVIFIGQILIVQFGGSIFRTVPLCLTDWLWIIGGTSLVLWIGESNRAIVRWRKS

SEQ ID NO: 2207 - protein, 7000 aa, Oreochromis niloticus
RQTPSPGDGGRGRGLKPGGKGPSPPEEPFGGFKLKPVQLKFIKKLKDIVLQEAESIGSSAVFECEVSPSTAITSWMKDDSNLRESPKHKFTSDGKDRKLHIIDVQLSDTGEYTCVAKNAGKEITCTAKLIVEELPVKWVKELEPETTCIKGQPMYLTCELNKERDVIWKRNGQVLKTKAGKVAVNVIGMQHAVTIQNSTDEDGGAYTCEVDGQEDVKTTTNVKVIETIKDWLVKPLRDQHVKPKAKATFKCELFKDTPNWKWFKGENELTPSDKVEITKDGKDMTLSINNCQPDDVADYTIQVEDRRYTAKLTLGEREAEILKPLSSVEVIEKEEANFDTEISEDDVAGEWKLKGQVLTRSPTCDIKAEGKKRFLTLKNVQLDQAGEVTYQALNAVTSAMLTVKEIEMGFVDPLKDLSVPEKKQAKFECTITKDVSKVIWFRGTEIVTPSPKYEIIDDGKKHMLIINNCEFDDEAQYTIEALGQKSAAQLMVEGMRLSFVQPLQDQTVKEGNSARFDLELSHENVPVVWYRNEVKLHVSRTVLIHVEGKRHTLEMRTLSLDDTCQIKAEAKGIYSMAKLTVVEGDPIFVVKLQDYSATEKEEVTLDCELSKDVPVLWYHEEKEIIASKMVIMRSEGTRRSLVLKKVELSDKGKYACDCGTDKTSANINIEEARDIKVVRPIYGVELFDGETARFEVEISEDDVHGQWKLNGAVLSPSSDVDIIEEGGKHTLILYNCKVSMTGEELPLNFLTPMTDVQVYEKDDARFEVEVSRTPKTFRWLKGSQELQSDEKYEVIQEGNLYVLVIRSAAYDDEAKYMFEAEDKRTTGKLVIQGIRLEFVKTIKDVTVKERETAEFSVELSHDKIPVVWYKNDVRLHPSKVVHMSAQAKVHTLAFKEVTIDDTSMIKVEAMDKSMTAMLTVIEGDAYFTTKLHNYTAVEKDEVKLVCELSKAVADVKWFKDGKEITPSKNIAIITDGKKRILMVRKAEKANIGEYTCDCGSDKTTAKLNIEERDIKVVRPLYSVEVTETETAKFETEISEEDVHGNWKLKGEALHQSADVEIKEEGTRHLLILYNVCMDMAGPVDFSAANARSSAQLRVKARSITLIHPLKDVTVTAGETAIFECELSYEGIAVEWFLGGQRMEASDRVKTRVAGRVHTLTVRDVNLSEAGEVKLTAKDFQTQAQLIVRVYLEPPVEFTKPLEDQTVEEEATATLECEVSRENAEVRWFREGQELRKTKKYDTIVDGRKRALIIHDCSPEDAKLYTCDAKDFKTSCFLEVTRTAPYVEFTKPLQDVEVREKESAKFECEVSRESAKVRWFKDGGEIRKGKKYEIIAKGVQRILIIHKSVFDDEAEYECDARTSKTSGMLTVIEEAARFTKNLSNVEGTETNTVKMICEVSKAGAEVTWYRGDEELPEGGRYEQQTDGRKRILIIRDLRMEDAGDYNCRLSPTVRTSATLKLNELAAEFIARPQNQEVVEGEKAEFSCSVSKDTYEVKWFRGDKEIEAGDKYSIISEGKRRALIVKSCELKDEGGYTAHIGTVKAVADLLVIEKLRIITPIKDTEVKEAGEIVFNCEANTEGAKAKWLKNEETIFESSKYMMAQRDNVFSLRIRDAQKADEAVYTVSLTNHRGEHAKCTASAKVAEEKLRFLEPIEDNETQEKKTISFVCKVNRPGATVRWLKAGQEVTLSKRIVYRADGLKHSLTIKDCIMEDEGEYTAVVGDDKCAAELIISEAPTDFTAQLKDQTITEFEDAEFTCKLSKEKAAVKWYREGREIRAGPRYQMEKEGKTCRLIIKVCRPDDECEYACGMDERRTRARLFVEETPVEIIRPPRDVFEPPGSDIVFEVELNKDRVEVKWMRNNMIIVQGDKYQMISEGKVHRLQVCEIRPRDQGEYRIVAKDKDARAKLELAAVPKIKTTDQNLVTDAGKPFVMTVPYDAYPRADAEWFFEGTSLPVQNIDTSLDKTEYRLKSPAKEDQGRYKVVIKNKHGEGEAFINLDVIDVPGPIKNLRVVDTVDGEVSLAWEEPENDGGSKIIAYVVERRDVKRKTWTVATDRADTPEYCVSGLQKESFYLFRVCARNRVGSGPTVATEDAVQAKNKFDVPDAPENVAVESVNKFGATITWEPPKFDGGSEITAYVIELRDRTSVKWEAALVCAADDRLAMLNDVVENKEYIFRVRAENKAGIGRPSAATNPVKIMDPIATERPSPPLNLNFSDQIKTAVTLTWETPVNNGGSMITGYIIEKCEDGSDKWLRCNARLCPDLSYRVSGLKPGQKYLYRVCAENAAGVSDPAEQLGPLLADDPHVGPTFDLSGFRKGLEVIVPQPLTVRVPITGYPTPVAKWTFGEKELTPADERVSMVTKPTYTELTISPSVRPDKGIYTLQLENDVSSVSGDIDVNVIACPSAPKDFKVAEVTRHHVHLMWEAPEHDGGSPVTHYQIEKREVSRKTWAKVAAGILDLEHTVTDVIEGKEYLFSVSACNKCGPGEPAYIDEPINVSSPATVPDPPENLKWRDKSAKTIFLSWEPPKYDGGAHIKGYVVDKCQRGTDKWEPCGDPIPELKFQVTGLVEGQWYAYRVRAFNKLGASRPCRATDEIQAVDAKEPPEIQLDVKLLAGLTTRAGTKIELPADVKGKPDPRVKWTKADVVLRADNRITIDTQPGHSKVSIDNTTRGDTATYIIEAVNACGRATATIDVNILDKPGPPAALDISEITNESCVLAWNPPRDDGGSPITNYIVESRQTDKEEWVKLSATVKHTTFKATKLTALKEYIFRVSAENQYGIGEPAEHVPITAKYSFDPPGPPTRTTPSDIAKDAVTLTWLEPDEDGGSPITGYWIEKLDPESDKWIRCNKLPITDTTFRVKGLTAKKKYRFRVLAENLAGPGNPSAETDPILIKDPIDPPWAPGKPVIRDIAKTSALLGWTRPEHDGGAKIEGYIIEFQKAGSEEWIKIAEDVPQTEHQLKGLIEKQEYSFRVRAVNKAGESEPSEPSDPVVCKERLYPPSAPQWLEVANITKINADLKWQPPSSDGGSPITNYVVEKRDVRRKAWQTVDTTVKEQKYTVTPLNEGSLYVFRVAAENAVGMGEFCELEDAVLAKDTFTTPGPPYALTVVEVTKRHVELKWEPPNSDGGRPITKYVIEKKEKVGTRWLKCCKTPDRKTQFKVTDVDEGSEVQFQVRAENEAGVGDPSEPTVILTIEDPTSAPSPPLEVVIPDASREHINVTWKPPVKDGGCPVTGYHVEVAEARPELKWLRVNSRPIKELKFRIDDGIKPEKKYVIRVRAINSVGVSDPSDVSDKVATKDPDCAPTMDLEAKDVIVVEGEKLHLNVPYRAIPTPKMVWQKDTVECKAGDRLSLTVEMNSAHLELLKCTRDDAGAYAITLENSLGTATGTVNVKVIGLPGQCKTITSSDVTKNSCKVSWEAPEDDGGTPIVSYTLERREASKKTYMPVMSGENVLTSTVKDLFVNCEYYFRVKAVNKVGAGEYLELQNPVIIEEIKQKPDPPIQVEAHDPTSKSITVTWKAPDYDGGCPIQGYIIEKIEKDGDRYERVTPSLVPGFSYVVMGLKEDMEYQFRVRAENAAGVSEPSRSSQPIKAADPVEKPKVTLHARVQSGLCIKKGEEICIDAYISGSPYPKVTWLRNDEDVTKEPTKKFIPVIKKKKTKAKVPEPEEEFVTPLRERLGIDQTKKGQSALMIRDAVRSDHGSFTIKVENTHGVATASCVVNVLDKPGAPINFTFDEIRNTSVICNWEPPEDDGGSEILNYILEKKDNKKDEIGWITVTSTLKGTSCPVTKLIEGKEYIFRVTAENKYGCGPPCISEPLVAKNQFSPPDAPNTPRVHEVTASTAHISWHEPKDNGSPILGYWIERKEVNSKHWTRVNRALLNSLEVKVTGLMEGLTYIFRVCAENLAGPGPFSDPTDRIVAMDEILPPGPPIPWIVDTGKDSVVVAWKPPLYNGGGDILGYHVEKVLAGEKDWSRSTEFRCKELTYTVTGLTEGADYYIRVLAVNDAGPGAPGVTEPVTVKEPQESPVVDFDDSVKNGVMIKAGESLRLPAVVRGRPQPEVKWAKDEAEIDKERMIVETVGKNSTLFIKKAVRADHGKYQITGTNSSGSKTAETRVDVMDVPGPVVDLKAVTVTKKNIVLTWSDPVDNGGSDIIGYEVLRKDANMKLFRQPIETASCKCDVQGLLAGEEYDFRVIARNKYGDGLPADLGPILAEDPKGTPSAPEKLHYTNRSKNTITLAWQPPRTDGGSPIRGYYVEKMRSDSTEFEVANRKIFTECCGTIENLSENQEYDFRVKAVNEVGEGDPSKRITVKIQDDEIAPSITILKFIKSNAINVRKGAAIDIPAEVRGLPLPTLQWMKDDVVIEKTDEEKMTMETEEVDRTTLRTKIAIPVTIRQDKGSYKLVAENCHGKAQQIIKVEILDRPLPPRNIVVSDIKADSCYLTWDAPEDNGGSEITNYIVERRDASKKKSDFDVLTINLIDRRFGVYKLDLNGTYQFRIKAENKYGVSDGCDSEKVQLRDPFGLPGPPRNPKIIAATATTMTVTWDPPLDNGGSTIQGYWLEKRERGAVYWGRVNRAPVTKPAVKGLQYTVLKLIEGTEYQFRISACNAAGVGPPSEATEYPPSIPGNPEIKDKTKNSVTLTWTPPDKDGGSPIKGYIIEVHEEGSPDWRRVNPADKLHPSTEITVPDLKEGKKCKFKIYAVNSAGNSEPARTGDILVQDILIEPTVTLDVTAHDLLNCRAGTTIKIPATITGRPVPKVTWTFDGTAETEKKNDLHTLPIDSEIHSTDTTSVIEIPACKLNHSGRYIINAESPAGHKVVKVRVSVLDLPGPPRDLKISDVTRGTCRLTWKPPECDGGERVKSYFIEKKTAEGKAWTKVNPACAAQSLVVPDLNEGQEYFFRVRAENRFGFGPYIATIQRTKARDPIHPPDPPTRLKIQSVRKGTVTLTWKAPKNDGGSPVTHYSVDLLCWDSSGTQKESWRRCNRRDVDTTSFKVEDLTEGDEYEFRVMAYNEVGPSRPSSTAGPITIQDQSCAPSIELNEFMEVEQGSDISIVAQIRGCPFPTLTWYKAPPHKSDAKVEVQYDEHINKIVSDDSCTLLIQQGKRPDTGLYTLVASNSLGKASKEMRLNVLGRPGPPSAPIKFEEIGAEKITLSWLPPKDDGGSKVTNYVIWRRVANRKTWVPVTSEPKERIWTVENLMTGHEYVFRIMAQNKYGVGEPLDSEPEVARDLYTVPGQVEKPTVTSVTMDSMTVNWEEPEDDGGSPITGYWLERKETTGKRWTRVTRDPIRPMGLGESFVVSGLIEGSQYLFRVSAINAAGPGLASPPTDPIFARDPITPPSPPTPKVSDWTKSTVDLEWIPPLKDGGSKIIGYWVEHKEEGTEAWVKAKDTEIRGTRFVITGLKTGGKYRFRVIAFNAAGNGEPGEVPEVLEVNDRIVAPEVDLDASVKERIVVHAGGVIRIIAYVSGQPSPDVTWSRDGAALPPEAKVETTAISSSLVIKPCTRKHLGVYILTAKNAGGEKTKKITVEVLDVPGPVGIPLVAENLSSDSCKINWFFPENDGGSPISNFVIEKREAERKAWTSLSYTASRQNAVAHDLTPGKAYFFRVAAENAIGIGPFVETAAEIVIKEPISVPDRPEEVEVTKVTKDLISIAWKAPKYDGGSEITMYILEARMIGKDKFTRLTKENLMDRKYTYDGLREGDTYEFRVIAVNEVGPSKPSFCTKPVTCKDELEPPTIELDFRDKIIIRVGESCLLQGRYTGKPPPSITWYRDDKELKADKHIMFKNTLTTMSLGLMKAEREHSGRYVVVVENSTGSRKGVCNITVVDRPTPPVGPVVFEEVHREYMVISWKPPLDSGGVDVSNYIIEKRDINRETWTTVTSASTKTTCKIPKLTEGREYIMRICAENMYGISDPLESEEMKAKDLFRVPEAPEMPTVREVYGTNALVLWNRPRDGGKPITNYILEKKETTAKRWSRVTRDPLYPATQYRVQDLVEGCEYEFRVMAENELGPGDPSVPSKPILAKDPIVRPSPPVTPEAYDKTKDSVSLKWKMPRHDGRGRIFGYLVEYQKPGAVEWMQANETPEQCPDLHYVVTGLAEGHEYKFRIFTVNAAGKSDPAYVKDTIKVHDRLEEPELLLDANMARDHLAMLGTDITLSATIKGVPTPTVSWKKNDADVPAHITVAVTATGSKVFIPKCVRADSGNYTITVENAAGKKTATVAVLVLNKPSPPRDLVISDVTSESAYLTWKAPEDNGGAVISHYIVQKKDVAAEQWVPVAAANKKLSLMAMYLMEGIQYLFRVAAENQFGRSDYVVTKTPIKAVDPLYPPGPPKNLHHTDADKTEVWLAWEWPDRTGGSEITGFIVEHQEEGQTDWVTFKTVSNNHTHVTGLEEGKTYRFRVKAQNAIGVSRPDTSVPVTCQEKTLPPTIEVDVKLIEGLIVKAGTTIALPAKMVGIPLPTAKWMTDGKEITSEGRYHIQSADSTTTLSIPECQRADTGEYILTVSNPAGSKTVALHVTVLDLPGPPIGPINIMEVTPDYMMIQWRAPKDDGGTPITNYVVEKKDVKKPWEPWSVVSSSGTVTRAKVSRLEKGREYIVRVRAENKIGIGAPLESPPTIAKHMFNPPGPPGLPECSDITENAVTVSWSLPDYDGGSPISGYVVERREMTGKWIRVNKTPVLDLRYRVSGLFEGNTYEFRVFAENIAGISEPSLTSDPIKATRAITKPGPPGNLKLKDWSKSHADICWTKPTRDGGSPILGYVIEAQKSGTAQWDRINKDLVKMCAYRVPGLIEGLEYRIRIRATNKVGDSEPRELPQTILAKDILVPPEVVVDVSCRDSVTVRAGQIISLITRVKGRPDPEITWTKDARALARDKRTQMNNNYPVCELIINDAVRSDYGKYAIVAKNSSGQAQATILVNVLDTPGACQNIKVAYVTKKSCMVSWENPEDNGGTEITQYIIECRQPSQRGWTVVSNDCTKRLIKAPLTESCEYFFRVSAENKIGTGPP

SEQ ID NO: 2208 - protein, 5696 aa, Oreochromis niloticus
RKVRKKVKVDTSKFMTPYLAHSQKMLEQFSHNKYRHAYEMSKGTPPAIVTDTPELIRIRKAQEQLSEVKYRMEGNKARTTSLYDGEAREIAHVKHVSELISKVLYRQKWDETKDRYLLPPDAPELVQAVKNAANYSKKLYTEAWDEDKTMYYPYSDSPELRRVAKAQEVLSDVHYKKGHHERKAKYTSLPDPPELELAKRVSQQRSDLKYKEDYNKNVKGQWCETPYFDVATARVAMENLSDRRYTQHYEDTKDQIYFMQTETPTYEANKKARIAASEVQYKKEYEKKKAESDYNTLPATDNPLLRQLRYAGTILSDKVYKANYEKSRGFSINYCDTPKFQMDSVLKSFSDAHYKDKYENEVKGHYIGSYEDLYMLHCQKVEEMKNEQLYKADYEDIKTRCFFPQTITPEYEAVKKLQQCSDNVYRQHPDTVKFTQVVDSPVQVQAAINAKQLSDLNYKAQYEEIKVKNSLPPDYPFFIQSRVNAFNLSDNCYKYDWEKTKAKKFEIKGDTISILAARAHTNAISDVKYKKEYEKNKGKMVGALSINDDPKMLHSVHVAKIQSDREYKKDYEKVKTKYHTPLDMLSVTLAKKSQAITSMAGYRSISTNYFLPPDSVLLDLAKKANVIQSDNEYKADYNSYTKGTPWVPYGSLEVEKAKKAAEILNEKKYRTHPDKIPFTSIDDHPIMMQAKVNQLQRSDLFYKRGLEEIHQKYSLPPDVPEFLQAKCNAYNISKNYYKLAWQELIAKGYDLKPDAIPIVAAKAARHAASDVQYKKAYEKARGHHVGFRSLQDDPLLVHYMQVAKIQSDKNYKKDYHKAKLKYHTPVDMLSVAHAKQASAVQTYVGYKQHHHKYFLLPDAMGLQLARTMNYNSSDHNYKMDYETSVKGIGWVPIGSLDVEKAKTAAAALNEKKYRQHPDTIKFTSVTDSMNMELAKTNAKIMNVKEYKASGEKFMHTYHLPPDAPQFLQARYNAANISQNYYTYSHRQDLLKGHHVKEDSIPIVAAKTSRNIASNYKYKLAYEKEKGHHVGFRSLQDDPLLVHYMQVAKMQSDKNYKKDYHKAKLKYHTPVDMLSVAHAKQASAVQTMAGYKKIPHSFLLLPDNLHLQLCRNMMAIQSDNVYKSDYNNYSKGIGWVPIGSLDVEKAKTAKAALDERNYRQHPSNFKYTSKTDAMNMTLAMANTKQMDITAYKASGEKFMHTYHLPPDCPEFLQAKFNAQTISESNYRHKWVEDIAKGYDMKPDAIPILHAKHGRHIASNVQYKKAYEKARGHHVGFRSLQDDPLLVHYMEVAKIQSDKNYKKDYHKAKLKYHTPVDMLSVAHAKQASAVQTMAGYKKIPHSYLLLPDNLQLRLCRTMNLQSSDNDYKSDWNNFVKGIGWVPIGSLAVETAKVGGQIQSEKKYRTHPSNFKFSKLMDSMDLALASANNQIMNKVQYFQKAYTAAWEKDKVTTHVMPDAPEILLAKANALNMSNKLYKAGVVEMANKGYNLKADAIPILAAKAGTTIASNYKYKLAYEKARGHHVGFRSLQDDPLLVHYMQVAKMQSDKNYKKDYHKAKLKYHTPVDMLSVLHAKQASAAQTMAGYRHIQHTNALLPDAMNLELARNMQLIASDNQYKSEYEHYIKGIGWVPIGSLSVETAKVGGQILSEKKYRTHPSNLKYSKLMDSMDLTLATANNQIMNKKAYTAAWEKDKLSVHIMPDAPEILLAKANALNMSNKLYKAGVVEMANKGYNLKGDAIPILAAKAGTTIASNYKYKLAYEKARGHHVGFRSLQDDPLLVHYMEVAKIQSDKNYKKDYHKAKLKYHTPVDMLSVVHAKQASAAQTMAGYRHIQHTNALLPDAMNLELARNMQFIASDNQYKSEYEHYIKGIGWVPIGSLDVEKVKSAGKALSEKLYRQPPSNFKFTKDMHSMDLTLATNNNQIMDKQSYIKAWEKDKTSIHVMPDAMGIVLARENRKNYSEKLYKLDHELSKKKGHNLRGDAIAVQAAKASTVIASDYKYKTGYRKQVGHHIGALSIQDDPLLMLALNSAKIASDALYKKDFNKSKTKFHLPVDMMAFELAKKNQIQVNHFNYITRLHNWTCLPDSNDVVQARHAYNLQSDVIIYVIIILLYCRTHVFYYISFLLSASFDHCKSFLVFVFLFQAIYKEDLKMLQGIGWVPIGSLDVEKVKKAGEILSEKKYRQLAKKCQIQVNDFNYRTHLHQWTCLPDSNDVVQARHAYDLQSDAVYKADLKWLQGLGWVPIGSLDVEKAKKAAEVLSERKYRQHPSKVPFTSPVDAMNLVLAKNNALTMNKRLYTEAWEKDKTTLHIKPDTPEIVLSQQNAITMSKVSIISEHDLLCQQEYFQNIFNIYSNFKKLLSVLIKTLSFIQNALQTLSLYNEVPKLEHFKKNCICLLLQKLYRQGYEETIKKGYFLPVDAISVKAAKASREIISDYKYKTGYRKQVGHHIGALSVKDDPLIVLALNSAKIASDALYKKDFNKSKTKFHLPVDMLAKKCQIQVNDFNYRTHLHQWTCLPDSNDVVQARKAYNLQSDAVYKADLDEVVGVGWIPIGSLDVLKAKNAAKILSDRLYKQKPDTLKYKTDMTSMPLVLAKTNADIMNKRNYIAAWDAEKIKVHVPPDIPELLLAKANAYNISKKIYKEAVEDIFRKGYDMKPDAVSVVAAKRAREIISDYKYKTGYRKQVGHHIGALSVKDDPLIVLALNSGKIASDVLYKKDFNKSKTKFHLPVDMLNLELAKKCQIQVNDFNYRTHLHNWTCLPDSNDVVQARKAYDLQSDAVYKADMEWIKGMGWVPIGSVDVEKAKKAAEILSERKYRQHPSNFKFTANTADMPYALAQANAQVMDKKAYIAAWEKDKTNIHVMPDTPEILLAQQNKLNTSLKFYREGYMEMINKGYYLPKDAVSVIAAKASRDIVSDYKYKAGFRKQCGHHIGALSVRDDPLIMLAANAAKIASDNVYKKDFNKTKTKFHLPVDMLTVELAKKCQQQVNDFNYRTYLHQWTCLPDSNDVVQARKVYDLQSDAVYKADLEWLRGCGWSPQDCIDVVKVKHAQTVLNERLYRQPPSTVKFTSVVDLPAIVLSKQNAENLSDRKYREVWDKDKLTIHVPPDTPTFELAKANAVNISNKLYTKAWDDQKAKAYHVKEDAVSVLKAKASRDISSDYKYKEGYRKQVGHHIGALSVKDDPLIVLALNSGKIASDVLYKKDFNKSKTKFHLPVDMLNLELAKKCQIQVNDFNYRTHLHQWTCLPDSNDVVQARKAYDLQSDAVYKADMEWIRGCGWIPHESVEVLKVKHAQKILADRGYRIKLDEQQFMVPADRIDLVRARNAAEVLNEAKYREAWHQDKTKYSLVDTPTLATAREVAKNVHPKLYTKEWDKVKATGYFMPPDAVPIKQCIQTTKVQSKHKYLEGYRKQVGHHIGALSVQDDPLLMLALNSAKIASDALYKKDFNKSKTKFNLPVDMLQFELAKKCQIQVNDDNYRTRLHQWTCLPDQNDVIQARKAYDLQSDHVYKSDLEWLRGCGWVAADSVEHVKVKKAQEILNDRLYKKNAQEGFGRFTLVVDRPEIVLAKINAANLSDLKYKETFNAEKGHYIGSDDTPQLAHSREVAKIISEKLYKSTWDESKATSYQLNHEYIPLVISKKSRDIASDVKYKDTHEKAKGHYMAGTLVDFPEVMRCGQQEKNKALRVYQKDYHQTKTKIHIPSDIIANQVAKRCQDMLSDVLYRTYLHQWTCHPDQEDAIRARKTNEILSDVFYKDDLNWMKGIGCYVWDTPEILRAKKSYDLQSDLKYRENAKKEFNNYSIVTDTPSYVTAVLGHTWASELNYREAYQKEKHVYTTVLDTHDYVRCQNFKYIFSNKNYTSTWDKIKAKSYQIPHDANALQHAKQQKIILSNVKYKEDYEKFKSLYSLPKSLEDDPGTARCVKAGKLVLDRLYKENYEKTKAKNHIPPDMLDILSARSTQNAVSEINYRKYLHQWICMPDMQMYVQARKVNEQLSDIFYKDDLNWLKGIGCYAWDTPEILRVKHAGNLQSENKYRAKGKDAFKEYSVVTETPVYETAKQNAQNLSDLHYRYDYNANIKGTNTAPAVTIETERARQANYIQSDNWYKEANKSFMPTGYSLPHDTPLIKQAKLNTVVSSNVKYKEAYEMVKAKGYTLHPEGVNFVTARKANKIINERLYRETYHKQKDKIHTTYDTPDIKQVKMNQEHLSDLRYKEKYYNSRGQLISMPITPELMHYHHVNEITSDLKYKEDLMWLRGIGCFLYNTPEMVRVRDVTKFRVNYPVEAKKNLDKFSVVLDTPEYKRVTELKTHMSNLIYKAQSKEDMAKVTTTADSVDIQRAKWAQQLTNQYQYVDLAAKQRAHFTPEINTPNMGHARKMKVVYSDNKYKEQYQKMKHRYTAIADTPLLIRAKKSYLQSSDLRYKETFELSKGHYRTVKDALDITYHRRVTDDISEVKYREKYISSLGTWKSIPDRPEFFFSKIVSGNVSDVKYKEDLDWLKGIGCFVWDTPELVQAERNKALYSERLYKASYEKNRGNFKYTSDTPFFQAAKQASVLINDRAYRAEYEKTKDKFTITTDDPRYQLARENRKMSQKMYKSRAKDLLKGGCNELLRPDILTALYQTTMGSKWKYREQYERAKDKFTSVLETPEYEAHKRSKKISDIIYKMEYNKTKAKAYTLPYDTPHQQHMKKVKELTSNLKYKEVYEKSKAHINMDPEAHEIRAAKEAYKNISNLDYKKKYEATKNQWIWTVDRPDFVNAAKNSLQQSDVEYKYDKEILKGCVIPVVDDKLTLLCMKNAEMASEVKYKHKYEKEKGHYIPVLDTPQILHAKAVRVLASESKYKEASKKEMQSGSFTTLSDTRDTAHSRTVNKLVSGNVYKEKFEKEKGKSIYNHMIVPPDVQHAMDVAKSQSNVAYKKDAKASLHYTTVVDRPDIKKATQAAKLISQIGYREKAREEASRGGSLAHRPDIALATEVSKLTSQVEAKPSLHGAASYDTPLMRHIKKMSAVTSDVKYKEKFDKEMKGKKPQYDLKESKIYKTLKEANVLASEVKYKGDLKKIHKPVTDMAESLSMKHITSTSRLSSDYCYKKKFEESKGHYHMIPDTPEQLHHKEASELQSNVKYKEKYEKEKGKPMLDFETPTYVTAKEAQHMQSQKDYKKDFEEYMRGKNLSGLEVTPAMIHVRHATKIASEKEYRKDLEEGVKGKGLTVLEETPELLRARNATQILCEREYKKSLEQEIKGKGMLALATDTPDFMRAKNATEILSQSKYKQTAEMDRASYTTVIDTPDIIHAQQMKNIVSQKKYKEEAEKTMSHYVPVLDTPEMQRVRENQKNFSTLQYQTDLKNIKGKVSTVKDTPEMLRVKENTKNFSLIKYKDSLGRGTAIPDLPEVKRVKETQKHISSVLYKDSSAKGTPVVFTPEMERVKRNQENISSVLYSDSFRKQVQGKAAFVLDTPEMRRVRETQRIISGVRYHEDFEKSKGSFTPTTTDLVTERVKKNTQDFSDISYRGIQRRVVEMERRRAIEHDQEGITDLRVWRTNPGSVFDYDPAEDNIQSRSLHMMSVQAQRRSKEHSRSTSALSGGADEKSEVSQDADHHMSLYSNGFMTSSIGYQHATVKTVELQQRSSSVATQQTTVSSIPSHPSTTGKTVRAMYDYTAADSDEVSFKDGDVIVNVQAIDEGWMYGTVQRTGKTGMLPANYVEAI

SEQ ID NO: 2209 - protein, 1934 aa, Oreochromis niloticus
MSTDAEMAVYGKAAIYLRKPEKERIEAQNKPFDAKSACYVADAKELYLKGTIIKKDGGKVTVKVLDTQEERTVKEEDVSPMNPPKFDKIEDMAMMTHLNEASVLYNLKERYAAWMIYTYSGLFCATVNPYKWLPVYDSEVVAAYRGKKRMEAPPHIFSVSDNAYQFMLTDRENQSVLITGESGAGKTVNTKRVIQYFATISVGGDKKKDSGKMQGSLEDQIIAANPLLEAYGNAKTVRNDNSSRFGKFIRIHFGQTGKLASADIETYLLEKSRVTFQLPDERGYHIFYQMMTNHKPELIEMALITTNPYDFPMCSMGQITVASIDDKVELEATDNAIDILGFSNEEKMSIYKMTGAVLHHGNMKFKQKQREEQAEPDGTEDADKVAYLLGLNSADMLKALCYPRVKVGNEYVTKGQTVPQVLNSVTALAKSIYEKMFLWMVIRINQMLDTKQQRNFFIGVLDIAGFEIFDFNTLEQLCINFTNEKLQQFFNHHMFVLEQEEYKKEGIVWEFIDFGMDLAACIELIEKPMGIFSILEEECMFPKATDTSFKNKLYDQHLGKCKAFEKPKPAKGKAEAHFSLVHYAGTVDYNISGWLDKNKDPLNESVLQLYQKSSVKLLGHLYPPVVEEAGGAKKGGKKKGGSMQTVSSQFRENLGKLMTNLRSTHPHFVRCLIPNESKTPGLMENFLVIHQLRCNGVLEGIRICRKGFPSRILYGDFKQRYKVLNASVIPEGQFIDNKKAAEKLLGSIDIDHDQYRFGHTKVFFKAGLLGTLEEMRDEKLAALVTMTQAVCRGFLMRKEFVKMMERRESIFTIQYNIRSFMNVKHWPWMKVYYKIKPLLKSAETEKELQQMKENYEKMKTDLATALAKKKEIEEKMVSLLQEKNDLQLQVASESENLSDAEERCEGLIKSKIQLEAKLKEVTERLEDEEEINAELTGKKRKLEDECSELKKDIDDLELTLAKVEKEKHATENKVKNLTEEMASQDESIAKLTKEKKALQEAHQQTLDDLQSEEDKVNTLTKSKTKLEQQVDDLEGSLEQEKKLRMDLERAKRKLEGDLKLAQESIMDLENDKQQSDEKLKKKDFETSQLLSKIEDEQSLGAQLQKKIKELQARIEELEEEIEAERAARAKVEKQRADLSRELEEISERLEEAGGATAAQIEMNKKREAEFQKLRRDLEEATLQHEATAAALRKKQADSVAELGEQIDNLQRVKQKLEKEKSEYKMEIDDLSSNMEAVAKAKGNLEKMCRTLEDQLSELKAKNDENVRQINDLGAQKARLLTENGEFSRQIEEKEALVSQLTRGKQAFTQQIEELKRHTEEEIKAKNALAHALQSARHDCDLLREQFEEEQEAKAELQRSMSKANSEVAQWRSKYETDAIQRTEELEEAKKKLAQRLQEAEEQIEAVNSKCASLEKTKQRLQSEVEDLMIDVERANGLAANLDKKQRNFDKVLAEWKQKYEEGQAEVEGAQKEARSLSTELFKMKNSYEEALDQLETMKRENKNLQQEISDLTEQIGETGKSIHELEKSKKQVETEKAEIQTALEEAEGTLEHEESKILRVQLELNQVKGEVDRKLAEKDEEIEQIKRNSQRVIDSMQSTLDSEVRSRNDALRIKKKMEGDLNEMEIQLSHANRQAAESQKQLRNVQAQLKDAQLHLDDAVRSQDDLKEQAAMVERRNGLMVAEIEELRAALEQTERSRKIAEQELVDASERVGLLHSQNTSLLNTKKKLEADLVQIQSEVEDTVQEARNAEEKAKKAITDAAVMAEELKKEQDTSAHLERMKKNLEAAVKDLQHRLDEAENLAMKGGKKQLQKLESRVRELEAEVEAEQRRGADAVKGVRKYERRVKELTYQTEEDKKNINRLQDLVDKLQLKVKAYKRQAEEAEEQANVHLSKYRKLQHELEEAEERADIAESQVNKLRAKSRDSGKGKDAAE

SEQ ID NO: 2210 - protein, 1525 aa, Oreochromis niloticus
MSTDAEMEAYGPAAIYLRKPEKERLEAQNTPFDAKTAYFVTDADDMYVKGKLIKREGGKATVETLTGKTVTVKEDDIHPMNPPKFDKIEDMAMMTHLNEPAVLFNLKERFASWMIYTYSGLFCVVVNPYKWLPVYDAQVVVAYRGKKRIEAPPHIFSISDNAYQFMLTDRENQSILITGESGAGKTVNTKRVIQYFATIAVAGAKKAETSGKMQGSLEDQIIAANPLLEAYGNAKTVRNDNSSRFGKFIRIHFGSTGKLASADIETYLLEKSRVTFQLSAERSYHIFYQLMTGHKPELLEALLITTNPYDYPMISQGEITVKSINDVEEFIATDTAIDILGFTADEKAGIYKLTGAVMHHGNMKFKQKQREEQAEPDGTEEADKIAYLMGLNSADMLKALCYPRVKVGNEFVTKGQTVPQVNNAVSALCKSVYEKMFLWMVIRINEMLDTKQPRQFFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLHDQHLGKTKAFEKPKPAKGKAEAHFSLVHYAGTVDYNISGWLDKNKDPLNDSVVQLYQKSSNKLLCFLYAAHAGADDASGGGKKGGGKKKGGSFQTVSALFRENLGKLMTNLRSTHPHFVRCLIPNESKTPGLMENHLVIHQLRCNGVLEGIRICRKGFPSRILYGDFKQRYKVLNASVIPEGQFIDNKKASEKLLGSIDVDHTQYKFGHMKLAQESIMDLENDKQQSDEKIKKKDFEISQLLSKIEDEQSLGAQLQKKIKELQARIEELEEEIEAERAARAKVEKQRADLSRELEEISERLEEAGGATAAQIEMNKKREAEFQKKLRRDLEEATLQHEATAAALRKKQADTVAELGEQIDNLQRVKQKLEKEKSEYKMEIDDLSSNMEAVAKAKGNLEKMCRTLEDQLSELKSKNDENVRQLNDMSAQRARLQTENGEFSRQLEEKEALISQLTRGKQAYTQQIEELKRHTEEEVKAKNALAHALQSARHDCDLLREQFEEEQEAKAELQRGMSKANSEVAQWRSKYETDAIQRTEELEEAKKKLAQRLQEAEESIEAVNSKCASLEKTKQRLQGEVEDLMTDVERANSLAANLDKKQRNFDKVLAEWKQKYEESQAELEGAQKEARSLSTELFKMKNSYEEALDDALRVKKKMEGDLNEMEIQLSHANRQAAEAQKQLRNVQGQLKDAQLHLDEAVRGQEDMKEQVAMVERRNGLMIAEIEELRAALEQTERGRKVAEQELVDASERVGLLHSQNTSLLNTKKKLEADFVQIQSEVDDAVQEARNAEEKAKKAITDAAMMAEELKKEQDTSAHLERMKKNLEVTVKDLQHRLDEAENLAMKGGKKQLQKLESRVRELEAELEAEQRRGVDAVKGVRKYERRVKELTYQTEEDKKNVTRLQDLVDKLQLKVKAYKRQAEEAEEQANTHMSRLRKVQHELEEAQERADIAESQVNKLRAKSRDVGKGSDSAE

SEQ ID NO: 2211 - protein, 7000 aa, Oreochromis niloticus
MSTQAPTFTQPLQSVVALEGSAATFEAQISGSPVPEVSWFRDGQVLSTTTLPGIQILFSDGRAVLRIPAVTAAHSGRFSVRATNGAGQATSTAELLVTVETAPPNFLQRLQSLTVRQGSQVRLDVRVTGIPTPAVKFYREGAEIQSSADFRILQDGDLYTLLIAEAFPEDSGTYSVTATNNSGRATSTAELLVQGEEAVPAKKLKTVSTSQITASQSRVQRKVETSFQASTKREIHAGEVMITQHLAHKTPPRVPPKPTSKSPPSYVSKVTAGRQQSPSPVRHVKGPTPTPVRPVSPSTKLSVSPIRPVKSPIMTRKQKVVSTSAEVLPPWKQGDYATEASYTSMASMTAVSSTTQLHMQKHWEQQVAATREVRVAQPACWLTQLHQYIQPDIFVLPWLLAVASNEGMAVVKNSKSVCKQEVSVRSFRNHIFKSQVEDVGEKKAEAVATVVAAVDLARVLKPVHGEGGRKEEEEDVELRIKQQAAATAEKQVIATKTLPIEPAVSAEQHRVQVSQIQRTTEIFSCVDTGVVQPPVPHFTVSKVSVPKHEPRHEVSLAGSAIATLHKELSSPSTPRKIIKPVKSPSPSRQAAVEVHVIPEPFLPPFRDVRYKTQLDSRGAYAFSEEEWTIFKLSCWFLQEVAAVPTRSQEPVVPPTLIAGLKNLTVTEGESVTLECKISSHPSPVIIWFREDYKIESSIDFQISYEHGFARLIIREAFAEDSGRFTCTATNEAGTVSTSCYLLVKVSEEIESREETAVTEIAITQEKTVAAEAKLQTVTEFSAGEPAAPFFIKKPTVQKLVEGGSVVFECQVGGNPRPHIIWKKNGVLLTTGYRYKVAYKETGECKLEISMTFADDAGEYSIFAKNPHGEASASTSLLEEEEYEAHMKQHDVTYKTEVTTTVVQEPSVVMSQYELEQRRTITPMSFVSETEFLISAFEERIIQKIELCIMRITYKELVAEDGELVVTIADEEAAQPAFDTPVKNYRIMEGAGVTFHCKMVGNPLPKIAWYKDGQRIRPSGRYQIEVLQDGRASLRLPVVLPEDEGVYTAFATNMKGNAVSSGKLYVEASEAVTPQRYTPQPAVQRIRSTSPRSLSRSPGRSSSRSPRRSPARRFDETDEAQLERLYKPVFVMKPSSIKCSEGQTARFDLKVVGRPMPDTYWFHNGQQVINDNTHKIVIKEDGTQSLIIVPAMPQDSGEWTVVAQNRAGRASLSVTLTVDAQETLARPQFVEKLKNITVKQGTLVELAVKAIGNPLPDIVWLKNSDIITPHKHPQIKIDGTKGEAKFQIPSASGSDSAWYTATAINKAGRDTTRCRVNVEVDFAAPQTERKLIIPRGTYKAKEIAAPELEPLHLRYGQEQWEEGDLYDKEKQQKPQFKKKLTSIRMKCFGPAHFECRLTPIGDPTMVVEWLHDGKPLAAANRLHMVNEFGYCSLDYEVAYARDSGVITCRATNKFGVDQTSATLIVKDEKGLVEETQLPEGRKGAYRMDEIERVAHEGGPAGVGADEESEKTKPDIVLLPEPARVLEGDIARFRCRVTGYPAPKVNWYLNGQLIRKSKRYRLRYDGIYYLEIVDIKSYDSGEVRVVADNPLGTAEHTVKLEIEQREDFRSVLRRAPEPKLAEATHEPGKIGFDIVKMDRPSEASQDREVVKLRKTQRIVHEKTSEESEELKSKFKRRTEEGFYESISAVELKSRKRDDSYEDLLRKTKEELLHHMKEKEEAERKKMEEQGKVTIPTIKPERVLLSPSMEAPKILERIASKTVAPMDEVRFRVRVVGRPEPECQWFKNGIQLEKSDRIYWYWPEDNVCELVIRDVETQDSASIMVKAINIAGESSSHAFLLVQAKTAVSFTQNLEDASAKEKDTMVTFECETNEPFVRVKWFKNNMEIFSGDKYRMHSDRKVHFLSVLMIEMRDDAEYTCVISDDENTRTSARLHVEGAALELIKHMENIEVPESYAGEFEVELSREDAEGSWLFGDKVLSPSNKYIISSRRGRHTLSVKDVRKEDQGKYTFVCGDLKTSASLKMKLRPVTLMQPLTDLIVCEGDIAQLEVRFSQENVEGTWMKNGQAISASERIHIVIDKMVHKLLVENVSTEDAALYSFVVPAQDISTSGKLSVQTIDIVVPLKDVSSIEGTKAVLEAKISAQDISSVKWYHNDKLLTPSDRIQMVAKGAKQRLVFTRTFASDQGHYKLVVGKVDTSCSLTVEEVHIVKHMEDKVCSESQNVTFNVEVSHPGIDSIWTFRNQQIKPGPKSKIESKGKAYSLTVIDAMKDEEGQYMFHAGEKTSSAKLTVSGGAITRPLQDVTVAESQTAELECEVANANAEGKWLKEGQPIDFNENVVSEVNGAIRRLIINITRPQDVGEYTYQVANSKTTANLRVEGVKIKKTLRNQTVTETQEAVFTLELTHPDVKGSQWIKNGVELQNSEKYEIISSGVVQTLKVKDCNIQDESVYSFKLGKLSANARLNVEKIKIVKKIKDATSLLDGTASFEMSLSHDNIPVRWMFKGLELTSSEKCKILSERKAHKLILKNLDSSDAGEYVAVVGHLQCSAVLTVEALQVTKPMKSVEVPETQVATFECEVSHFNVPSTWLKNGVEIEMSDKFRIVVQGKLHQLKIMNTSRDDSAEYTFVCGNDQVSATLTVNPVLITSMLKDLNAQERDTITFEVTVNYEGITYKWLKNGVEIKSSDRCQVRSRQLTHSLTIRNVHFGDGGEYKFVAGSGATTANLFVEARVIEFTKKIKDIKITEKKKAVFECEVSEPNIQVMWMKDGQEMDMSERYIVTAEKYVHRLVIQTVRMSDAGEYSVVAGSSVSKARLTVEGRDIRISEPPEREITVLEKHRATFEFEVNEEDVEGHWLKNGVEIQFSMEDRFNYVTIRKLHRLTISETYRSDAGEYTFIAGKNRSTMQLRINIPEPPQILRHMEPQSVEAGKPARFSVQVSGVPQPQVFWYKNSQALSAGFKCKFLHDGNEHTLLLIEVFPEDAAVYTCEAKNEYGTATSTATLNVEVSEVVSPDSPATVAPPVIISPIASTSACEGAPACFQCKVRGDDVKISWFHKKKEVKQSEFFRISQFDDSCQLEISRVYPEDDGEYTCMATNNGGTVSCSATLTLDGTEKTSDDKHSEKLEEEKVSATVPPVFRQKITPLEINVGSHTKFECEIEEAPDVTFKWYKSGTEIRQSEKYRIISCHTSSTLELLNPVKADSGEYTCKASNQHGTDSCTASLIVTEPPEFLLKPPANKFVKQGESLRLECKVSGTVPLKITWYKNDTKVTDGGNYRTSFVDSVAVLELVSTSFEDDGVYTCEAQNDAGSVSCSTTLTIKDPPSFVKIPQPVEGLKGKDVSLYCEMSGTAPFQITWFKDRKPLMESRKFKLVSEGSSATLHVIGIEPSDAGEYECKVSNSVGSDTCHTSIKLREPPSFVKRLSNMTVILGGEVTLVATVKGSEPITVSWVQDKDHILRDSDNRKITYENNQVAVKIFNADATTAGKYTCQLRNDAGSVECFANLTVLEPAKIVDKPDALSVTAGDMAALEVKVCGTPELIPKWFKDGAELASGRKYKISFSRMISSLNVLSAEKVDSGEYTFEIMNEVGKDLSKINLTVLETDKTIPPTFSRKLKDCTTVVGKPLEMECKVSGSSPFTISWYHNDEEIKSGPNYEISFSDNNCTLKVLTLKLADSGAYKCKAVNKAGTTETTAFLVVRDPEPPTFVVPPQPVEAMPGSNVTFSAMVKGSAPLKLKWFRGTKEIVAGHGYDFSLDDNKVLLELYNVDKSHAGEYTCQIINDAGKESYPVNLTVKEPATFSKKLKDISVEKGKPLTLECTYTGTPMITVSWYKDGQQIFASYKYNITTTESSCILECLSTDDKEAAGRFCCQVCNDAGKDTCEAVVSILEPPYFTESLEPMEVTAGDAVCLKCQVAGTPEIKVSWFKADGKVRSSPTCKLEYTKGVACLKLSKATKSDIGEYTCKAENRIGSASSSCRLNVLEAKTPPSFPKKITSLQQTEGQPVRFECRVAGSLPIEVSWLKDGKPLSQGEEFSMLYDDNTAVLQINNSEMRHSGEYTCVATNSVGSASCRAKLTLQEPRYPPVFDRKLSLQEVTVGDSIELECHMTGSAPIKVTWSKDHKDIRSGGNYKISCVDNTPHLTILKADKSDTGRYFCHASNDMGKDSCSSDITVKERKNPPVFTKKPSEHIEDMEGKLVKIEGRVSGSQPMSVSWFKDDTEIQSSDKYDISFKSNVAVLCIKNSQVNDSGRYSCQASNEAGKASCDVTVGISEAKKPPVFDVPLKPATVDEGEKLILRCHVCGSSPLKIQWMKDRKELTPSSSTRISFSDGTACLEISTVSKLNAGDYLCKATNEAGSEFCKAKVTVKAEAPAASPSKKMDNLFFIEEPKTAHVTEKGTATFIAKVGGDPIPSVKWMKGKWRQVTHGGRISIEQKGQEAKLEIREVTKSDSGQYRCVASNKHGEIECSTDMHVEEKKDVAMLEGDLRAKLKKTPSKQKSPQEEKDIDIVELLRNVDPKEYEKYARMYGITDYRGLLHAIEQLKKERAEESGRQEVDRGDRESDEDMARLVADLQKRMERTEPVTVVKDISNQSVFINEEAVFECEIKINYPEITLSWYKGTQKLDTSDKYNITISGDRHLLRVKNCQSSDQGNYRVVCGPHISSAKLSVMEVEVEKHLQDTMGKEGQSCTMSCQMSIPNVEAQWFKNGKQLKMKDRYTSEVKHKVQKLLIRDLKPEDQGRYTCKYQQLESSADLWVEAEQIHFTKRIHNIEVNERQSATFECEVSFDNAIVSWYKDTWELKESPKYNFRSEGRRHFMVIQNVTVEDEGVYSVIVRLEPRGEAKSTAELYLSGKEIELAMVPIDMPDSSVQRPEVPTRADFIHCLLSLLKLPEKISESVPERPTEKVLKPKKGMKEIPKLEPEDLPEKVPEKPHLLKHRTAASVEKIEEEKWERFEETSFEPKKRAKRTETESKERHTKVHYRQQGFDTGKREKRNSSFRREVEEEQEIIILKKIPSVPHKEPEQEELPLVTKTTVVNVEEMVHKKTPKTPKEEESAPPSTALKKVKKLPLDEVEPEVVKLKPFEKPLKPAEDPEKDKKKGERLPRQVETTEPPKQSEKEPVEVKELPAKVPKPGDQKKSPEKEPEEDKRPKKKPAEEKERPTDDLPKRHTSPAETPEERKQKAKPKKPEIPEAPEEKPVKPEKVDVAPLEKTILSVPAPAEKPEKVLEEKKPLQEKEEEVSLKPVEQLKKVELKKTPSPKATSRMKSKQTPSPGEGRGRGLRPGGKGPPPPEEPFAGFKLKAVPLKFIKKLQNIVLQEAESIGSSAVFECEVSPSTAVTSWMKDGSNLRESPKHKFTSDGKDRKLNIIDVQLSDTGEYTCVAKNAGKEISCTAKLIVEELPVKWIKELEEETSAIKGQPVYMTCELNKERDVIWKKNGEVLKKKEGKIQINIIGMQHAVTIQNSTEEDAGVFSCEVAGQEDVKTTTNVKVIEIVKDWIVRPLRDQHVKPKAAATFKCELFKETPNWKWLKGENEVQPSDKIEIKKEGKELTLVIKNCQPDDVAEYALEVEGRIYTAKLTLGEREAEILKPLVSVEVVEKEDAMFETEISEDDIPGEWKLKGEVLTRSPTCDIQMEGTVRRLKLKNCQLDQAGEVTYTALNAITSAMLNVKEVEMDFVVPLKDVSVPEKKQAKFECTITKDVFKVMWYKGADIITQDQKYDIIDDGKKHMLIINCCEFDDEDEYMIEVLGKTSKARLTVEGIRLKFISPIKDQTVKEGKTARFELELSHENIPITWYKNDNKIHPSRTVVIHVDGKKHALEMREVTLDDICQIKAEAKGILSMANLTVIEGDPYFTVKLQDYTAVEKDEVVLDCELSKDVDVMWYHNEAEIKASKTVNIKAEGKRRVLIIKRVGDKDKGQYLCDCGTDKTTATLHIEARHIKVVRPMYGAEVFDGETARFEVELSEDDVHGQWKLNGELLSPSTDVEIVEDGAKHTLVLYNCRVPQTGEVMFTAANAKCSANLKVKESTEVPVSFITPLADVHVYEKDEAKFELEISREPKSFRWLKGSQELSTDDKFELHVEGKRHSLIVKSARYEDEGKYMFEAEDKRTSGKLMIKGIRLAFIKPIRDVTVKERETAEFSVELSHEKIPVVWYKNDVRLHPSKVVHMSEEGKVHTLAFKEVTIDDTSMIKVEAMGKTSEAMLTVLEGDLYFTVKLQNYTAVEKDEVILSCELSKAAAEVKWFKDGEEIFPSKNISFKSDGKKHMLVIKKAAKSNMGAYSCDCGTDKTTADLNIEERDIKVVRPLHSVEVTETETAKFETEISEEDLHATWKLKGETLHPSANVEIKEEATRHLLILYNCKMDMAGSVDFAAANAKSSAQLRVKARVIGLQRPLKDVTVTAGETATFECELSYEGIAVEWFLGGTKLEPSDRVVLKAEGKVHTLTLRNVEQNEAGQIKLTAKDFQTEASLTVKEPPVEFSKPLEDQTVEEEATATLECEVSRENAEVRWFRDGQEIRKTKKYEMIIDGCKRALVIHDCTLDDSKTYACDAKDFKTSCFLNVEPPHIEFTKPLHDVEVVEKESARFECEVSREDVKVRWFKDGNEIRKGKKYEIIAQGRQHILIIHKSVFDDEAEYECDAKTSKSSGMLTVVEEEARFTKNLFNVEGTETDSVKLICEVSKPSADVIWYKGDKELPEGGRYEQTVDGKRRILLIKDLNMSDAGEYNCRLSPSNKTSGNLKINELAAEFISRPQSLEVVEGEKAAFTCSVSKETYEVKWMKDDVELEAGEKYQIVTDGKRRTLEIKDCELKDEGGYIVMIGPTRASADLTVLEKLKIITPLKDTEGKEGQEVVLNCEVNTEGAKAKWLKNDDTIFESSKYVITQRDNVFSLRIKDVQKGDESNYSINLTNQRGEHAKSHCSLTIREESLRIVVPPEDIDTQEKRTISFSCKVNRPNATLKWMKAGEEITFSKRIVYRVDKDKHTLTIKDCTLADEGEYTAVAGDDKATAE

SEQ ID NO: 2212 - protein, 1081 aa, Oreochromis niloticus
MSTDAEMEQYGPAAIYLRKPERERIEAQTAPFDAKTAYFVAVPDEMYVKGKLVKKEGGKATVDTLGGKTVTVKEDDIHPMNPPKFDKIEDMAMMTHLNEPAVLFNLKERFASWMIYTYSGLFCVVVNPYKWLPVYDAQVVVAYRGKKRVEAPPHIFSISDNAYQFMLTDRENQSILITGESGAGKTVNTKRVIQYFAIIAMTASKKAEPTPGKMQGSLEDQIIAANPLLEAYGNAKTVRNDNSSRFGKFIRIHFGTTGKLASADIETYLLEKSRVTFQLSAERSYHIFYQLMTGHKPELLEALLITTNPFDYPMISQGEVTVKSINDVEEFIATDTAIDILGFTAEEKVGIYKLTGAVMHHGNMKFKQKQREEQAEPDGTEVADKIAYLLGLNSADMLKALCYPRVKVGNEMVTKGQTVPQVNNAVSALCKSIYEKMFLWMVVRINEMLDTKQPRQFFIGVLDIAGFEIFDFNSLEQLCINFTNEKLQQFFNHHMFVLEQEEYKKEGIEWEFIDFGMDLAACIELIEKPMGIFSILEEECMFPKASDTTFKNKLHDQHLGKTKTKQRLQGEVEDLMIDVERANALAANLDKKQRNFDKVLAEWKQKYEESQAELEGAQKEARSLSTELFKMKNSYEEALDHLETIKRENKNLQQEISDLTEQIGETGKTIHELEKAKKTVETEKSEIQTALEEAEGTLEHEEAKILRIQLELNQVKGEIDRKLAEKDEEMEQIKRNSQRVIDSMQSTLDAEVRSRNDALRIKKKMEGDLNEMEIQLSHANRQAAEAQKQLRNVQGQLKDAQLHLDDALRGQEDMKEQVAMVERRNGLMVAEIEELRVALEQTERGRKVAEQELVDASERVGLLHSQNTSLLNTKKKLEADFVQVQGEVDDAVQEARNAEEKAKKAITDAAMMAEELKKEQDTSAHLERMKKNLEVTVKDLQHRLDEAESLAMKGGKKQLQKLESRVRELEAEVEAEQRRGADAVKGVRKYERRVKELTYQTEEDKKNLVRLQDLVDKLQLKVKAYKRQAEDAEEQANTHMSRLRKLQHEMEEAQERADIAESQVNKLRAKSRDIGKAEKAE

SEQ ID NO: 2213 - protein, 1003 aa, Oreochromis niloticus
MENSHTKTPAECLAYFSVNENSGLTPDQFKKNLDKYGFNELPAEEGKSIWELVIEQFEDLLVRILLLAACISFVLAWFEEGEETVTAFVEPFVILLILIANAVVGVWQERNAESAIEALKEYEPEMGKVYRSDRKSVQRIKAREIVPGDIVEVSVGDKVPADIRIVSIKSTTLRVDQSILTGESVSVIKHTDPVPDPRAVNQDKKNMLFSGTNIAAGKAIGVAVATGVSTEIGKIRDQMAATEQEKTPLQAKLDEFGEQLSKVISLICVAVWAINIGHFNDPVHGGSWIRGAVYYFKIAVALAVAAIPEGLPAVITTCLALGTRRMAKKNAIVRSLPSVETLGCTSVICSDKTGTLTTNQMCVTKMFVVKTVDGDHVDLDAFDISGSKYTPEGEVSQGGAKVNCSSYDGLVELATICALCNDSSLDYNESKKIYEKVGEATETALCCLVEKMNVFNSNVKNLSRIERANACCTVIKQFMKKKFTLEFSRDRKSMSVYCTPVKGDGGPKMFVKGAPEGVIDRCAYVRVGTTRVPLTNAIKEKILSVIRDWGTGRDTLRCLALATRDSPLKVEEMNLEDSTKFADYETDLTFVGCVGMLDPPRKEVTDSIELCRAAGIRVIMITGDNKGTAIAICRRIGIFSEDEDVSGRAYTGREFDDLPLHEQSEAVRRACCFARVEPAHKSKIVEFLQGYDDITAMTGDGVNDAPALKKAEIGIAMGSGTAVAKSASEMVLADDNFSSIVAAVEEGRAIYNNMKQFIRYLISSNVGEVVCIFLTAALGLPEALIPVQLLWVNLVTDGLPATALGFNPPDLDIMGKPPRSPKEPLISGWLFFRYMAIGGYVGAATVAGAAWWFLYDTTGPGVTYYQLSHFMQCHEENEDFEGLDCEIFEAAPPMTMALSVLVTIEMCNALNSLSENQSLVRMPPWSNFWLISAMTLSMSLHFMIIYVDPLPMIFKLTHLSTEQWIVVLKLSFPVIAIDEVLKFVARNYVEGKESCTFIHENKN

SEQ ID NO: 2214 - protein, 514 aa, Oreochromis niloticus
  MOD_RES (194)..(194): Any amino acid
KTKQRLQGEVEDLMIDVERANALAANLDKKQRNFDKVLAEWKQKYEESQAELEGAQKEARSLSTELFKMKNSYEEALDQLETMKRENKNLQQEISDLTEQIGETGKSIHELEKAKKTVETEKSEIQTALEEAEGTLEHEEAKILRIQLELNQVKGEIDRKLAEKDEEMEQIKRNSQRVIDSMQSTLDAEVRSRXKKKMEGDLNEMEIQLSHANRQAAEAQKQLRNVQGQLKDAQLHLDDAVRGQEDMKEQVAMVERRNGLMVAEIEELRAALEQTERGRKVAEQELVDASERVGLLHSQNTSLLNTKKKLEADLVQVQGEVDDAVQEARNAEEKAKKAITDAAMMAEELKKEQDTSAHLERMKKNLEVTVKDLQHRLDEAENLAMKGGKKQLQKLESRVRELEAEVEAEQRRGADAVKGVRKYERRVKELTYQTEEDKKNLIRLQDLVDKLQLKVKAYKRQAEEAEEQANTHMSRLRKVQHEMEEAQERADIAESQVNKLRAKSRDVGKGESAE

SEQ ID NO: 2215 - protein, 900 aa, Oreochromis niloticus
AVETQITYTNSYTIQHEDTYMTQEEDWDRDLLLDPAWEKQQRKTFTAWCNSHLRKAGTQIENIEEDFRNGLKLMLLLEVISGERLPKPDKGKMRFHKIANVNKALDFICSKGVKLVSIGAEEIVDGNVKMTLGMIWTIILRFAIQDISVEETSAKEGLLLWCQRKTAPYRNVNVQNFHISWKDGLALCALIHRHRPDLIDYSKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTIPWLENRVAEQTMRAMQQKLEDFRDYRRVHKPPRVQEKCQLEINFNTLQTKLRLSNRPAFMPSEGKMVSDIANAWKGLEQVEKGYEEWLLTEIRRLERLDHLAEKFKQKCAMHEAWTAGKEDLLSQKDYESASLMEIRALMRKHEAFESDLAAHQDRVEQIAAIAQELNELDYHDAATVNTRCQGICDQWDNLGTLTQKRRDSLERVEKLWETIDQLYLEFAKRAAPFNNWMDGAMEDLQDMFIVHSIEEIQSLITAHDQFKATLPEADKERMATLGIHNEILKIAQTYGIKLSGINPYTNLSLQDISTKWDTVKHFVPLRDQMLQEEVARQQANERLRRQFAAQANIIGPWIQTKMEEISHVSVDIAGSLEEQMNSLKQYEQNIINYKSNIDKLEGDHQLIQESLIFDNKHTNYTMEHIRVGWEQLLTTIARTINEVENQILTRDAKGISQEQLNEFRASFNHFDRKRNGMMDPDDFRACLISMGYDLVSGRAGEVEFARIMTLVDPNNTGVVTFQAFIDFMTRETAETDTAEQVMASFKILASDKNYITVEELRRELPPEQAEYCITRMTRYAGPDSPPGALDYISFSSALYGESDL

SEQ ID NO: 2216 - protein, 1384 aa, Oreochromis niloticus
MASKVIPWYKKKHVSQVKTDYAYQHTKHVSKQHTESKSSSKSVSQAQAQATEAMAEQAYTIPVFRQRTAEETEEYQRVSKNVGKGLAVIQEELQRMRIATKAQVESLEIQKEVKGMMRKRVDLLEEIPKLPDFLVALRPHTVWEKTPVKLFCTVEGNPRPIVKWYKDGVPVDPLSAPGKYKIENKYGVHSLIVSRCVVSDTAEYSAVATNQHGTATSKAKIIVKRPAGAGESCQLGLVPHLTEIHASKLDVSLLDRFPVSFGVEGNSIRLVCTMVVVPDLPNIPPIAQWYRDDKLLKPSKLVEMSVGGGAASLTLPHLAKDDEGLYTLRIFTKDGTAEHSAYLFVSDAAPSAPGAPGAPMSVKAYDVNSDYVLVAWKPPNTVNEAPITGYFVDRCEAGTDTWVQCNDAPVKICKYPVHGLRVGHSYYFRVRAVNSSGISRPSRKSDKVTALDAAESERLQGTDEGVPSAPGHVVATRNTKSSVFVQWEAPKHLKHLMGYYIDGRVVGAKEWFACNHKPFKHTRFVVHGLIPGETYVFRVQAVNLFGLSEESQESSPIAVEPALATPSAPFGITMLSSDGSSITVAWKSPKHCGGSKVNAYYIDKRDADTLVWKEVNLNAVTERMCTVENLKEGTFYEFRVTAGNMAGVGLPSAASIPMKCEAWTMEEPGPAYDLSFSEVRSHSLVILWRAPIYTGASAVTGYFVDMAKKGSSEFVTLNQEAVSHRYLQVTGLEEGESYVFRVRAVNAHGVGKPSQLSEPVCAKAIPGTKEIVAGVDEETGDVFLSLEACEICETSKFVWSKNYKPIGDCPRVAVTTKGRTSRLTFTNPDKDDLGKYSVIVTDTDGVSGSHTLTEDALNTMLELSYAIRHPIVPLKHGLNYEVLEKGHVRFWLQAVKLSPSVSYRFIVNDKEVTSGEGQKISHDVATGIIQMTVDHFTRANEGTYTVQIHDGKAKTQSSLVLVGDVFKAALKEAEFQRKEHIRKQGPHFSEYLYFTVTEDCTVMLVCKVANVKKESTLHWYKDDEEIVPDTPPNVMSGSCALPLPLFSRKDHGVYKAVLSDDRGKDTSVFDISGKVFDDIINAIAQIAGASASELVLQCTPEGIRLQCYMNYYTEEMKTVWKHKESKIASSEKMRIGGTAEMAWMQICDPSDKEKGHYTMEISDGVKTHTRTFDLSGQAYTDAYEEYLRLKAAAFAEKNRGRVVGGLPDVVTIMEEKSLSLTCTVWGEPTPEVTWFKNEQEVASTEHTRVTFDGGKFASLVINKVTPEDSGKYSINVRNKYGGEFVEITVSVYRHGEKIPEPKLGQPKAAAATPVPPKSPAPPSKTPTPTPSKAQTPAPSMKSPTPASTPISKSPTPTPKSPTPPRSVKSPTPPRFMKSPTPPRK

SEQ ID NO: 2217 - protein, 377 aa, Oreochromis niloticus
MCDDDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDAGDGVTHNVPVYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETAYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 2218 - protein, 514 aa, Oreochromis niloticus
KATVETEGGKTVTVKEDDIHPRNPPKFDKIEDMAMMTHLNEPAVLYNLKERYASWMIYTYSGLFCVVVNPYKWLPVYDATCVAAYRGKKRIEAPPHIFSISDNAYQFMLTDRENQSVLITGESGAGKTVNTKRVIQYFATIAAIGAKKAEPTPGKMQGSLEDQIVAANPLLEAYGNAKTVRNDNSSRFGKFIRIHFGTTGKLSSADIETYLLEKSRVTFQLSAERSYHIFYQLMTGHKPELLEALLITTNPYDYPMISQGEVTVKSINDVEEFIATDTAIDILGFTADEKINIYKLTGAVMHHGNMKFKQKQREEQAEPDGTEVADKIAYLMGLNSADMLKALCYPRVKVGNEMVTKGQTVPQVNNAVSALCKSVYEKMFLWMVIRINEMLDTKQPRQFFIGVLDIAGFEIFDFNSLEQLCINFTNEKLQQFFNHHMFVLEQEEYKKEGIQWEFIDFGMDLAACIELIEKPMGIFSILEEECMFPKASDTTFKNKLHDQHLGKTKCFEKPKPAK

SEQ ID NO: 2219 - protein, 1947 aa, Oreochromis niloticus
EMSSDADMAVFGEAAPYLRRPERERIEAQNKPFDAKTAVFVADPKELFVKGTLQSKEGGKATVKTLSGQVVTVKEDEIFPMNPPKFDKIEDMAMMTHLNEAAVLYNLKERYAAWMIYTYSGLFCVTVNPYKWLPVYNQEVVVAYRGKKRQEAPPHIFSISDNAYQSMLTDRENQSILITGESGAGKTVNTKRVIQYFATIAGSGDRKKDAAVTGKLQGNLEDQIISANPLLEAFGNAKTVRNDNSSRFGKFIRIHFGTTGKLASADIETYLLEKSRVTFQLAAERSYHIFYQIMSNKRPELIETLLITTNPYDYPFVSQGEISVASIDDSEELMATDSAIDILGFTGEEKIGIYKLTGAVMHYGNMKFKQKQREEQAEPDGTEEVADKAAYLMGLNSADLLKALCYPRVKVGNEYVTKGQTVQQVYNSIGALAKSVYEKMFLWMVLRINQMLDTKQPRQFFIGVLDIAGFEIFDYNSLEQLCINFTNEKLQQFFNHHMFVLEQEEYKKEGIEWEFIDFGMDLAACIELIEKPMGIFSILEEECMFPKASDTTFKNKLYDQHLGKSSNFQKPKSVKGKAEAHFSLVHYAGTVDYSITGWLDKNKDPLNETVVQLYQKASLKLLAFLYSNYASSEENTGGSGAVKKAAKKKGASFQTVSALFRENLGKLMTNLRSTHPHFVRCLIPNETKTPGIMEHHLVIHQLRCNGVLEGIRICRKGFPSRILYGDFKQRYKVLNASVIPEGQFIDNKKASEKLLGSIDVDHTQYKFGHTKVFFKAGLLGLLEEMRDEKLASLITITQALCRGFLRRKEFQKMMARRESIYIIQYNIRSFMNVKHWPWMKLYFKIKPLLRSAETEKEMAMMKVEFAKCKEDLAKAEAKKKELEAKMVSLLQEKNDLCLQIQAESESLADAEERCEGLIKNKILLEAKAKELSERLEDEEELNAELTAKKRKLEDECSELKKDIDDLELTLAKVEKEKHATENKVKNLTEEMSCLDDTIAKLSKEKLALQEVHQQTLDDLQAEEDKVNSLTKAKIKLEQQVDDLEGSLEQEKKVRMDVERAKRKLEGDLKLAQESIMDLENGNQQLKEHLKKKDFELSQLVSKIEDEQSAAVQCQKRIKELQACNEELVEELEVERVARAKVEKQRCDLSRELEEISERLEEAGGATTAQVELNKKREAEFQKLRRDLEESTLHHEAIAAALRKKHADSVAELGEQIDSLQRVKQKLEKEKSEYKLENDDLSSNMEIMVKAKINYEKLCHSLEDHLSEYKTKHDENTHLITEVNAQKARLQNENGELSRLLEEKEAILSQMLRSKLAFTQQVEELKRQVEEEIKAKNALSHALQSARHDCDLLREQYEEEQEAKAELQRGMSKANSEVAQWRTKYETDAIQRNDELEEAKKKLAQRLQEAEEAIEAVNAKCSSLEKTKQRLQGEVEDLMADVERANAQAAGLDKKQRSFDKILSEWKQKYEETQAELDGVQKESRSLSTELFKTKNSYEEALDQLEVLKRENKNLQHIEEISDLTEQLGENGKAIHELEKTKRQNETEKTEIQTALEEAEASLEHEESKILRIQLELTQVKGDIDRRMAEKDEEIEQMKRNHQRVLETMQSALDAEMRSKNDTVRIRKKMETDLNDMEIQLSHANRQAAEAQKQLRNMQSHLKEQTIHLDEALQNQEDLKEQVAMVERKSSLLQAEVEELRAALEQSERSRKLAEGEVADACERVGLLHSQNTSLLNSKRKLDADVSQLQGEVQDAIQEARNAEEKAKKAITDAAMMAEELKKEQDTSSHLERMKKNLEASVKDLQHRLDEAENLALKGGKKQLQKLEARVRELEGEVELEQKRAADAIKGVRKYERRIKELTYQTEEDKKTVLRLQDLVDKLQLKVKAYKRQNEEAEEQANVHLAKLRKVQHELEEAQERADIAESQVNKMRAKSREFGKSQAAESE

SEQ ID NO: 2220 - protein, 1947 aa, Oreochromis niloticus
IMSTDAEMAQYGPAAIYLRKPEKERIEAQNRPFDARTACFVPEPKELYIKGVVQSREGGQVTVKTEADETVTVKDEDCLPMNPPKYDKIEDMAMMTHLNEPSVLFNLKDRYAAWMIYTYSGLFCVTVNPYKWLPVYDPQVVAAYRGKKRMEAPPHIFSVSDNAYQNMLTDRENQSILITGESGAGKTVNTKRVIQYFATIAVSGGDKKDHSTGKIQGTLEDQIISANPLLEAFGNAKTVRNDNSSRFGKFIRIHFGTTGKLASADIETYLLEKSRVTFQLSEERSYHIFYQILTGHKPELIEMLLITTNPYDFPMISHGQISVASINDKEELVATDTAIDILGFSSEEKVSIYKLTGAVMHYGNMKFKQKQREEQAEPDGTEVADKVAFLMGLNSADLLKGLCYPRVKVGNEYVTKGQTVPQVANAVSALAKSVYEKMFLWMVIRINEMLDTKQPRQFFIGVLDIAGFEIFDFNSMEQLCINFTNEKLQQFFNHHMFVLEQEEYKKEGIDWEFIDFGMDLAACIELIEKPMGIFSILEEECMFPKASDASFKNKLYDQHLGKTNAFQKPKVVKGKPEAHFSLVHYAGTVDYNISGWLEKNKDPLNESVVQLYQKSSMKLLSYLYASFSSAEAESGGDAGGGKGGKKGGKKKGGSFQTVSAVFRENLGKLMTNLRSTHPHFVRCLIPNEIKKPGVMDNHLVIHQLRCNGVLEGIRICRKGFPSRILYADFKQRYRILNASAIPEGQFIDGKKASEKLLGSIDIDHTQYRFGATKVFFKAGLLGTLEELRDEKLASLVTQTQALCRGYLMRKEFSKLIAQRDCVWILQYNLRSFMNVKHWPWMKLFFKIKPLLKSAATEKEMATMKEDFIKCKDDLAKSEAKRKELEEKMVSLLQEKNNLLLQVQADSENLCDAEERCEGLIKSKIQLEAKLKEVSERLEDEEEMNAELTAKKRKLEDECSELKKDIDDLELTLAKVEKEKHATENKVKNLMEELAGQDENMTKLSKEKKALQEAHQQTLDDLQAEEDKVNTLTKAKSKLEQQVDDLEGSLEQEKKIRMDLERAKRKLEGDLKLSQESLMDLENDKQQAEEKIKKKEFENSQLLSKISDEQTINNQLQKKIKELHARIEELEEEVEAERAVRAKIEKQRSDLARELDEISERLEEAGGATAAQIEMNKKHEAEFLKLRRDLEESTLHHEATTAALRKKQADSMAELGEQIDNLQRIKQKLEKEKSELKMETDDLASNMETVAKAKVNLEKMCRSLEDQLMELKTKNDENMRQISDLSNQRARFQTENAELSRQMEERESLISQLTRGKQGFTTQVDELKRLIEEETKAKNALAHSLQSARHDCDLLREQYEEEQEAKAELQRCLSKANSEVALWRNKYETDAIQRTEELEEAKKKLAQRLQEAEEQIEAVNSKCASLEKTKQRLQNEMEDLMVDVERSNSLAATLDKKQRNFDKILAEWKQKYEESQAELEGTQKESRSLSTELFKLKNSYEEALDHLETMKRENKNLQQEISDLTEQLGESGKTIHELDKFKKQVETEKYDMQAALEEAEASLEQEESKILHVQMELNQMKAEVNQKLAEKDEEIDQMKRNHQRVLESMQATLDAEVRSRNDALRVKKKMEGDLNEMEIQLNHANRQAAEAQKHLRNIQGQLKDAQIHLDESVRGQEDMKEQVAMMERRTALMQAEIEELRAAVEQTERSRKVAEQELIDASERTGLLHSQNTSLLNTKKKLEADVTQLHCEIEEAVQEARNAEDKAKKAITDAAMMAEELKKEQDTSAHLERMKKNLEVTVKDLQHRLDEAENLAMKGGKKQLQKLEARVRELENELEAEQKRSTEAIKGVRKYERKIKELTYQSEEDKKNNIRLQDLVDKLQSKMKAYKRQAEEAEEQANVHMARFRKVQHELEEAEERADMAESLANKMRAKSREIGSKKYDRSK

SEQ ID NO: 2221 - protein, 412 aa, Oreochromis niloticus
TVETEGGQTVTVKEDDIHPRNPPKFDKMEDMAMMTHLNEPAVLFNLKERYASWMIYTYSGLFCVVVNPYKWLPVYDATCVAAYRGKKRIEAPPHIFSISDNAYQFMLTDRENQSVLITGESGAGKTVNTKRVIQYFATIAALGGKKAEPTPGKMQGSLEDQIVAANPLLEAYGNAKTVRNDNSSRFGKFIRIHFGTTGKLSSADIETYLLEKSRVTFQLSAERSYHIFYQLMTGHKPELLEALLITTNPYDYPMISQGEITVKSINDVEEFIATDTAIDILGFTAEEKLSIYKLTGAVMHHGNMKFKQKQREEQAEPDGTEAVADKIAYLLGLNSADMLKALCYPRVKVGNEMVTKGQTVPQVNNAVSALCKSVYEKMFLWMVIRINEMLDTKQPRQFFIGVLDIAGFEIFD

SEQ ID NO: 2222 - protein, 1934 aa, Oreochromis niloticus
MGDSLMAEFGKAAPYLRKSEKERLEAQTRPFDIKTECFVVDTKEEYVKGKILSKDGGMVTVQKEDGTTVTVKESDTHPQNPPKFDKIEDMAMFTFLHEPAVLFNLKERYAAWMIYTYSGLFCVTVNPYKWLPVYDAEVVAAYRGKKRSEAPPHIFSISDNAYQYMLTDRENQSVLITGESGAGKTVNTKRVIQYFASIAAVGGASKKDSSKGTLEDQIIQANPALEAFGNAKTVRNDNSSRFGKFIRIHFGTSGKLSSADIETYLLEKSRVTFQLKAERNYHIFYQILSNQKPELLDMLLITNNPYDYSYISQGEVTVASINDSEELMATDGAFDVLGFTPEEKMSVYKLTGAIMHYGNMKFKQKQREEQAEPDGTEAADKSAYLMGLNSADLIKGLCHPRVKVGNEYVTKGQSVDQVYYAIGALAKSVYEKMFNWMVVRINQSLDTKQHRQYFIGVLDIAGFEIFDFNTFEQLCINFTNEKLQQFFNHHMFILEQEEYKKEGIEWEFIDFGMDLQACIDLIEKPLGILSILEEECMFPKASDQTFKAKLYDNHLGKNKMFEKPRAAKGKAEAHFALVHYAGTVDYNIAGWLVKNKDPLNETVVGLYQKSSLKLLSLLFSNYAGADGGDKGSGKGAKKKGSSFQTVSALHRENLNKLMTNLKTTHPHFVRCLIPNERKTPGVMDNCLVMHQLRCNGVLEGIRICRKGFPNRVLYGDFKQRYRILNASAIPEGQFIDCKKSTEKLLGSLDIDHTQYKFGHTKVFFKAGLLGTLEEMRDEQLSRIITRIQANARGLLMRKEFIKLVERRDALMVIQWNLRSFLGVKNWPWMKLFFKIKPLLKSAESEKEMANMKDEFNKLKETLEKSEARRKELEEKIVTLLQEKNDLTLQIQSEQDTLTDAEERCEQLIKSKIQLEAKLKEMTERLEDEEELNADLTAKKRKLEDECSELKKDIDDLELTLAKVEKEKHATENKVKNLMEEMASQDENIAKLTKEKRALQEAHQQTLDDLQSEEDKANTLTKAKAKLEQQVDDLEGSLEQEKKVRMDLERSKRKLEGDLKLIQENLMDLENDKQQLEEKIKKKDFEVTQITSRLEDEQIASVQLQKKLKESQARIEEVEEELDAERAARAKVEKQRSDLSRELEDISERLEEAGGATSAQVELNKKREAEFQKLRRELEESTLQHEATAATLRKKHADTVAELGEQIDNLQRVKQKLEKEKSELKLELDDLCSNMENVVKTKANFEKMCRTMEDNMNEYKSKCEEAQRTINELTTQRAKLLTENGELGRQLEEKDCLISQLTRGKNSYNQQMEDLRRQLEEELKAKNALAHAVQSARHDCDLLREQFEEEQEAKAELQRALSKSNTEISAWRTKYETDGIQRTEELEEAKKKLVQRLQEAEEAIEAVNAKCSSLEKTKHRLQNEIEDLMLDLERSNAASAALDKKQRTFDKVLAEWKQKFEESQCELEASQKEARSLSTELFKLRNAYEECLDQLETMKRENKNLQEEISDLTDQLGEGGRSAHELEKIRKELEQEKVELQSALEEAEGSLEHEESKILRAQLEFNQVKADMERKLAEKDEEMDQAKRNYQRMVESLQSSLESETRSRNEAMRVKKKMEGDLNEMEIQLSQANRQAAEAQKQVKTLQAFLKDTQLQLDDTQHGNDDLKENIALLERRNNLIQAELEEVRAALEQTERSRKLAEQELTEATERMQLLHSQNTSLINQKKKHEADLLHLQCEVEEAIQENRNAEEKAKKAITDAAMMAEELKKEQDTSAHLERMKKNMEQTIKDLQHRLDEAEQIAMKGGKKQLQKLETRIKELENELEAEQKRGAESIKGVRKYERRIKELTYQTEEDRKNMARLQDLVDKLQLKAKSYKRAAEEAEEAANINMAKLRKLQHELEEAEERADIAESQVNKLRAKTRDGSSKKGLDE

SEQ ID NO: 2223 - protein, 1014 aa, Oreochromis niloticus
LGYHLELKERNNILWVKQNKQLVPETRFKVIGLEEGIEYEFRVYAENIVGLSKASKVSEIQVARDPCDRPGKPEAVIVTRNQVTLRWTKPQYDGGIKITGYIIEKKEGAGRWMKASFTNITETEFVVTGLIENQIYEFRVIAKNAAGVFSQPSDSTGAITAKDEVDPPKIDLEAKYSQAVVVNAGETFKLEATVYGKPVPTIHWLKEGQEITEAARLELKNTDFTACLVVKEAIRVDGGQYILLVKNVGGEKSVNINVKVLDRPGAPEGPISIYGVTNEKCSISWKPPLQDGGSDVSHYTVERRETSRLVWTVVEPKVQTLNLKITKLLPGNEYIFRVIPVNKYGVGEPLESEPMVARNPFVTPNPPTNVEVSTITKDSMVVTWERPTNDGGSPIQGYIVEKRDKDGVRWTRCNKRNISELRFRVTGLLENHSYEFRVAAENAAGVGMPSAPTVYYKALDPVFKPGPPNNPKVVDTSRSTVSLTWGKPIYDGGCEVQSYIVEACNGASDEWFMCTPPTGIMDTKYTVKKLLEKHEYQFRVCAINKVGVGEHADVPGKILLEEKLEAPDLDLDADMRKMINIRAASTLRLFVPVRGRPAPEVKWGKADGEIKETAQIDNTGSYASLVIENVDRFDSGKYTLTAENASGVKSVFISVRVLDSPSPPTNFVVKEITKNSVTLTWEPPHLDGGSKIKYYIVEKRESTRKVYSPITTCNKMSWKVEPLPEGGIFFFRVLAENEYGVGLPAKTIEPVKISEKPQPPGKVSVVDVTHSTVTLTWEKPLHDGGSRITHYEVELAPKDSETWSICASVKALETLVTNLLKGEEYQFRVVAVNDKGKSDPRQLAHSVIAKDLVIEPAVRPKASSYSVQVGYDLKIDVPVAGHPKPIITWTKDGVALKQTTRVNVTDSAQTTTLTIKDATREDGGMYTISVSNDLGSKNATVEVITLDKPGPPTGPVKLEDISAESITLSWEPPTYTGGCPISNYVVEKRDTTTTNWSVVSATVARTTLKVSNLK

SEQ ID NO: 2224 - protein, 1362 aa, Oreochromis niloticus
DKYVREEPMIRGPKFLVRLRSHMVFENTPVKIVCTVEGFPMPVVKWYKDGMILDLSSGRYLVETKGGIHSLEIPRCSTDDTAQYTAMAVNLHGQASTQASIIVKRFKQEEESCSYAWLPYAASMLPKIHYTKIHITFLDTFGPVFATEGESATLSATMTLEPNLANLQPEAQWYRDDTRLFDSKWVKIETGRGFSKLTLPNLYKDDEGLYTLRMVTKGGTAEHSAFVSVADGPPPVPAAPGAPMDIEIHDANRDYVIVSWKPPNTTTEGPILGYFVDKCEVGTENWTQCNDHPIKICKYPVSGLFEGHSFYFRVRAVNSHGISKPSRMSDPITAMDPTEFERLHAKRLGGRLDIVSYYDEVEAEGKPPGVPSGINASETDRTYVVLSWKAPAYTSRAPMWYYIEKCMADSGAWQRVNTQVPIRSPRYAVFDLAEGKQYKFRVLSANIYGTSEPSEPTGPIQTQELKGVPSAPGQVIATRETDTSVLIQWAPPKEPNNLIGYYIDQCVQGSKNWTSANHKPHKNTRFVVSGLTTGETYVFRVQAINELGLSDESQESAPLTVKAALTTPSAPYDIALLYCDGHSMILNWKKPLRSGGAKIKEYYVDKRRSGTTMWREVHIPPFTERVYKVENLTEGAVYQFHVYAANLAGLGPASKHSEDFTCDPWTMPEPGPAYDLTFCEVRDNSLVVEWQKPVYTGSGPITGYHVEYAKKGTANWITANEKAASHRFLKVTGLEVGTTYVFRVRAVNAAGVGMASMASDPVTAKAVAGSQEVSCVVDEKSGDIVLSFESCQINEGSKFIWKKDYKEITDFSKGVVIKSEGTHSKLIFKNPDKEDFGTYSVSVTNTEGVSSSYTISNEELAKMLALSYDIRHPVIPLKSELAYKILERGRMRFWLQAEEISSNVTYKFFANNKELSGADPNKMGHDVATGIIEFIMDHFTEENEGTYTCQITDGGGKAQSSLVLIGDAFKAALAEADFQRREYIRVKEGPHFSEFLSLQIGDDCSVTLVCKVANLKKESVFHWFREDTEIIPDVKPDLGSGVCKLPIKEFSLKTAGIYKATISDDRGKDMSQINISGKVFDDAINKLSQLAGASAAELVINCTATGIQLQCHMKYYTLEMNITWYHGKIALFCDRNHTAIIFYKELIDSQVVEPVEKDKGKYSIVITDPENSHKRTLDLSGDVYEKAFAEFQKLKAEAYAEKNRGKVVGGLPDVVTIMEKKTLSLTCTVCGDPKPQVSWLKNGSEVEPDDQYVVSLDQGRFASLTIKGVSMEDSGRYTMIVQNKYGGESVDIVVSVYRHGEKIPEAKPTLTPKTIIPPKLPIEIPQPKTQPAPSAAPSTPSPAAPKAALGRGVKSPTPSRRK

SEQ ID NO: 2225 - protein, 1180 aa, Oreochromis niloticus
MSAWIKRGSYNHEYHHKQSQYVVKEYSSSEAMEERYEHKTKTRIQEVVRTKLDDKYVREEPMIRGPKFLVRLRSHMVFENTPVKIVCTVEGFPMPVVKWYKDGMILDLSSGRYLVETKGGIHSLEIPRCSTDDTAQYTAMAVNLHGQASTQASIIVKRFKQEEESCSYAWLPYAASMLPKIHYTKIHITFLDTFGPVFATEGESATLSATMTLEPNLANLQPEAQWYRDDTRLFDSKWVKIETGRGFSKLTLPNLYKDDEGLYTLRMVTKGGTAEHSAFVSVADGPPPVPAAPGAPMDIEIHDANRDYVIVSWKPPNTTTEGPILGYFVDKCEVGTENWTQCNDHPIKICKYPVSGLFEGHSFYFRVRAVNSHGISKPSRMSDPITAMDPTEFERLHAKRLGGRLDIVSYYDEVEAEGKPPGVPSGINASETDRTYVVLSWKAPAYTSRAPMWYYIEKCMADSGAWQRVNTQVPIRSPRYAVFDLAEGKQYKFRVLSANIYGTSEPSEPTGPIQTQELKGVPSAPGQVIATRETDTSVLIQWAPPKEPNNLIGYYIDQCVQGSKNWTSANHKPHKNTRFVVSGLTTGETYVFRVQAINELGLSDESQESAPLTVKAALTTPSAPYDIALLYCDGHSMILNWKKPLRSGGAKIKEYYVDKRRSGTTMWREVHIPPFTERVYKVENLTEGAVYQFHVYAANLAGLGPASKHSEDFTCDPWTMPEPGPAYDLTFCEVRDNSLVVEWQKPVYTGSGPITGYHVEYAKKGTANWITANEKAASHRFLKVTGLEVGTTYVFRVRAVNAAGVGMASMASDPVTAKAVAGSQEVSCVVDEKSGDIVLSFESCQINEGSKFIWKKDYKEITDFSKGVVIKSEGTHSKLIFKNPDKEDFGTYSVSVTNTEGVSSSYTISNEELAKMLALSYDIRHPVIPLKSELAYKILERGRMRFWLQAEEISSNVTYKFFANNKELSGADPNKMGHDVATGIIEFIMDHFTEENEGTYTCQITDGGGKAQSSLVLIGDAFKAALAEADFQRREYIRVKEGPHFSEFLSLQIGDDCSVTLVCKVANLKKESVFHWFREDTEIIPDVKPDLGSGVCKLPIKEFSLKTAGIYKATISDDRGKDMSQINISGKVFDDAINKLSQLAGASAAELVINCTATGIQLQCHMKYYTLEMNITWYHG

SEQ ID NO: 2226 - protein, 381 aa, Oreochromis niloticus
MPFGNTHNNFKLNYKVEEEFPDLSKHNNHMAKVLSKEVYGKLRDKQTPSGYTLDDVIQTGVDNPGHPFIMTVGCVAGDEESYEVFKDLLDPVISDRHGGYKPTDKHKTDLNHENLKGGDDLDPNYVLSSRVRTGRSIKGFTLPPHNSRGERRIIERLSIEALNSLDGEFKGKYYPLKTMTDAEQEQLIADHFLFDKPVSPLLTCAGMARDWPDGRGIWHNENKTFLVWVNEEDHLRVISMQKGGNMREVFRRFCVGLQKIEEIFKKHDHGFMWNEHLGYILTCPSNLGTGLRGGVHVKLPKLSTHPKFEEILTRLRLQKRGTGGVDTASVGGVFDISNADRLGSSEVEQVQLVVDGVKLMVEMEKKLEKGESIDSMIPAQK

SEQ ID NO: 2227 - protein, 4922 aa, Oreochromis niloticus
WSISMLGQQDIQFLFWDDEVVLQSVATIQKEHRKFCLAAEGLGNRLCYLESTSEAKYVPPDICICNFVLEQSLSVRALQEMLANTGQNSEGSADHEKWRLIKKAGQGGGHRTLLYGHAILLRHSFSGMYLTCLKTSRSLTDKLSFDVGLQEDSIGESCWWTIHPASKQRSEGEKVRIGDDLILVSVSTERYLHLSISNGNIHVDASFMQTLWNVQPTCSSSNMAVGYLIGGHVMRLCHGHDESLTIPGADKNEEEQRIVNYEAGKGASKARSLWRVEPLRISWSGSHIRWGQPFRLRHLSTGHYLALTEDRGLVLQDRVKSDTTATAFCFRASKEKGDTGPKRDIDGMGVPEIKYGDSVCFIMHVATGLWLSYQAPDAKSSRLGPLKRRACLHSEGHMDDGLILQRCQHEESRAARIIRNTTFLFTNFIKALDSIAAGESTAVAGYVEEVLQTLNDLIEYFKQPDSELEHEEKQCLLRSLIKRQDLFKEEGMLSLLSKCIDRMNLYDSAAHFGEVAGEEAGAAWKDILNLLYELLAALIRGNRNNCTQFSRKLDWLVSKLERLESSSGILEVLHCILVESPEALNIIQKGHIKSIVSLLYKHGRNHKILDVLCSLCVCNGVAVRANQNLICDNLLPNRDLLLQTRLVNDVQSMRPNIFLGIAEGSAQYKKWYYELVIDQVDHFVTSEPTHLRVGWANTKGYAPYPGGGEGWGGNGVGDDLYSYSFDGLHLWSGRIPRAVASINQHLLNSDDVVSCCLDLGAPSMSFRINGQPVQGMFEDFNTDGFFFPVVSFSAGVKVRFLLGGRHGDFKFLPPAGYSPCYEALLPKEKMHVEPVKEYKRDHDGVRDLLGTTQFLSQASFIPTPVDTSQIVLPPHLENIRDKLAENIHELWGMNKIELGWTYGKVRDDNKRQHPCLVDFAKLPETERNYNLQMSSETLKTLLALGCHVAQVNIHAEDDLKKIKLPKNYMMSNGYKPAPLDLSDVRLNAGQEVLVDKLAENAHNVWAKDRIKQGWTYGIQQDLKSRRNPRLVPYALLDERTKKSNRDSLREAIRTMVGYGYEIDPPDQEVVHVLDDQSVETIRFFRVEQTYAVKTGKWYFEFEALSGGDMRVGWARPGCRPDVELGVDDQAFVFDGYRGRRMHAGSRYFGHPWKKGDVVGCMINMEDKSMIFTLNGELLITNKGSELCFTDFETEDGFIPVCSLSMSQIGRMNLGKDASTFKYYTMCGLQEGFEPFAVNMNREVTMWFSKRLPTFFNVPEEHPDIEVTRIDGTVDSPPCLKVTHKTYGTQNSNNDMVYCRLSMPVEFYSADKLLDESLKLRSDMEIVFYLNLYLKLKTKAHSVSVMFFVSAAILQKKMEVLTLEASQLITDSTVFPFSFNWQYYYSVRVFAGQDPASVWVGWVTPDYHYYSKNFSLSKTRTVTVTLGDERGRVHESVQRSNCYMVCVADAVTPSSSSRSSSDLEIGCLADLATGLVSFTANGKELPTSYQVEPNTKLFPAVFVLPTSANLFQFEFVKIKDAMPLSSAIFKSEHRNPVPQCPPRLDVQTIVAVLWSRMPNIFLNVETARVSERHGWVVQCLEPMQMMAVHIPEENRCLDIMELSEHEDLRKFHYHTLKLYCALCALGNTRVAHALCSHLDQSQLLYTIDNQYLSGMLREGFYNVLISIHLETAKEARLMMNNEFIIPVTDETRSIKLFPDESKQHSLPGVDLSTSLKPRVNFSPVGIINTKRQQYLYSPQIPLGILKEKAISMLTEAVQGGGTHIRDPVGGSLEYQFVPILKLIGTLLIMGVLTSDEVRLILLLIDPNVFGETKEGEEVKGDEVAMSGEKEEVSKNEEKAVEAGEEETKESKPQVKGLLEKSLPESVKRQMCELLHYFCDCELKHRIESIVSFSDSFVSKLQYNQKFRYNELMLALNMSAAVTAKKTKEFRSPPQEQINILLNFSAGEDCPCPEEIQDELNSFHEELRLHCGIPVEEEEEEQDTSIKGRLLALLYKIKGPPQKTEQEPTETEQAAPTNLKELISQTITSWAQESHIQDPELVRVMFSLLRRQYDGIGELLRAMKKSYTISAASVQDAINLLASLGQIRSLLSVRMGKEEEKLMIDGLGDIMNNKVFYQHPNLMRVLGMHETVMEVMVNVLGGDKSQEIAFPKMVASCCRFLCYFCRISRQNQKAMFDHLSYLLENSSVGLASEAMRGSTPLDVAASSVMDNNGLALALEEPDLEKVVTYLAGCGLQSCAMLVAKGYPDLGWNPIEGERYLSFLRFAVFCNGESVEENANVVVKLLIRRPECFGPALRGEGGQGLLAAMEEAIKISEDPALDLPKTPAGVTTGSGEEEGEVIHMGNAIMSFYSALIDLLGRCAPEMHLINAGKGEALRIRAILRSLVPTSDLVGVISIPLKMPVVNKDGTVTEPDMSACFCPDHKAPMVLFLDRVYGIEDQSFLLQMLEVGFLPDLRASASLDTEALSTTETALAMNRYIGSALLPLLTRCAALFGSTEHHAQLVDSTLQTIYRLSKGRSLTKAQRDAIEECLLAICKHLRPSMMQQLLRRLVFDVPVLNEYCKIPLRLLTNHYEQNWKYYCLPSGMGSFGTASEEELLLTKKLFWGIFDSLSHKKYDAELFKMAKSCLCAIAGALPPDFVDSSLGATLEKQASMDAQGNFDPKPISTANISLPEKLEYIANKYAEHSHDKWSSEKMSVGWKHGDTVDEQAKTHPLLKPYKSLSEKERETYRWPVRESLKSMLSMGWNIERTKEGEAMFQQRESEKQRKISESQINGFSPAPMDLHNVTLSRELQGMVEVVAENYHNIWAKKKKTELVSKGGGTHPLLVPYDTLTAKEKYRDREKAQELFKFLQISGYAITRGLKDMEQDSSSMEKRFSYKFLKRLLKNVDSAQEFIAHLEAMATSGKTDKSPHDQEIKFFAKVLLPLTDQTFKNHCLYFLSTPSQNLSSCGCASNKEKEMVTSLFCKLAALVRHRISLFGSDSAMMVSCLHILTHSLDTRTVMKTGSELVKVGLKTFFENAAEDLDKLLEMLKLGKFMQSRAQMKSVSQSINYVTVALLPILTALFEHIKTYEFGVDLLLDDVQLSCYRILTCLYSLGTGKNVFVERHLPALGESLATLVGAMPVAFLEPHLNAHNPLSVFNTKTPRERAILSMPDTVEEMCPEMPRLDKLLKDVNDVSESGARYSDMPQVIEVILPMLCNYLSYWWEKGPENSPPDTQCCTMVTSEHLSIILGNILKILNSNLGIDDAPWMKRIAVYSQPIICKAGADLLRTHFLPTLDKLKKKTVKVVAEEELLKADSKGDNQEAELLILDEFAVLCRDLYAFYPMLIRYVDNNRSRWLKEPDGDSTELFRMVAEIFILWCKSHNFKREEQNFVVQNEINNLGFLTGEGKTKMSKTGGDQERKHKRRRGEYYSIQTSLIVAALKKMLPIGLNMCTPGDQELISLAKIRYSLKDTDDEVKEHLRQNLHLQDKSDDPAVQWQMNLYKDVVVKIEEPANPENTVDRVQSISAAVFHLEQNKLNWGCRIIPVFKVEQPLRNKKCVWQKLLSKQRKRAVVACFRMAPLYNLPRHRAINFFIPAYERLWIEAEEYSFEEKLVQDLAKTPMKIVEEEEEEVAEIQPDPLHQLILHFSHNALTERSHLEEDPLYIAYADMMAKSCAEDEEEEEEEEGKEKTFEEKEMEKQKILYQQARLHARGAAEMVLQMISASKGRLGPMVTCTLKLGISILNGGNVQVQQKMLDYLKEKRDAGFFKSLSGLMQSCSVLDLNAFERQNKAEGLGMVTEEGSSSKVLQNDEFTKDLFRFLQLLCEGHNGDFQNFLRTQTGNTTTVNIIISTVDYLLRLQESISDFYWYYSGKEIIDETGKLNFSKALSVAKQIFNSLTEYIQGPCIGNQQSLAHSRLWDAVVGFLHVFANMQMKLSQDASQIELLKELMDLQKDMVVMLLSLLEGNVVNGTIGKQMVDTLVESSSNVEMILKFFDMFLKLKDLTTSDNFKEYDPECKGIISKKEFHKSMESQKQYIQSEIEFLLSCVEADENDMFNYKEFVERFHEPAKDIGFNVAVLLTNLSEHMPHDSRLATFLDLAESVLSYFEPYLGRIEIMGSAKRIERVYFEISESSREQWEKPQVKESKRQFIFDVVNEGGESEKMEMFVNFCEDTIFEMQLASQISEPEVVEQPEEDEEEDGHSILEELTAEEEHALESASAFTTACRSVSGKIAHVRQMFSIKNMRKKFKKLKKLSIKEIITGFFAFFWMLFTGFFKGIYSLIFGFFHVIWSSMFGGGLVEGAKNIKVTDILGNMPDPTQFGIHGDVIEGEKVEAIESLGNLDIAMAPTGDIVEVDMMMEMLNAPKKEGGKHVEPGLGDVSELSAEPSTDHKKQKAAAKKVETPENEPEKADTENQEKEDKPKEEAAKEPVTEEKPKTRSSQPKEPAPAFMSSIFAVLDVYLNKTVNYLARNFYNLRFLALFVCFAINFILLFYKVTQASVQVTGETDEETEGENRWGADEEDDEDTLFDMDEFVLQESTGYMLPTLRFLAIFHTVISLVCLVGYYCLKVPLVVFKREKEIARKLEFDGLYITEQPSDDDIKGQWDRLVINTPSFPNNYWDKFIKRKVINKYGDLYGAERIAELLGLDKSALDFDPTVETVEKEASLVSWLSSIDTKYHIWKLGVVLTDNSFLYLIWYTTMSIFGHFNNFFFAAHLLDIAMGFKTLRTILSSVTHNGKQLVLTVGLLAVVVYLYTVVAFNFFRKFYNKSEDEDEPDMKCDDMMTCYMFHMYVGVRAGGGIGDELEDPAGDPYELYRILFDITFFFFVIVILLAIIQGLIIDAFGELRDQQEQVKEDMETKCFICGIGNDYFDRTPHGFETHTLQEHNLANYLFFLMYLINKDETEHTGQESYVWKMYQERCWDFFPTGDCFRKQYEDQLG

SEQ ID NO: 2228 - protein, 363 aa, Oreochromis niloticus
MPHAYPFLTPEQKKELNDIALKIVAPGKGILAADESTGSVAKRFQSINAENTEENRRLYRQLLFTADNRISPCIGGVILFHETMYQKTDDGKPFPQYLKERDMVVGIKVDKGVVPLAGTNGETTTQGLDGLYERCAQYKKDGADFAKWRCVLKITPTTPSRLAIIENANVLARYASICQMHGIVPIVEPEILPDGDHDLKRCQYITEKVLAAVYKALSDHHVYLEGTLLKPNMVTAGHSCSHKYTNQEIAMATVTALRRTVPPAVPGITFLSGGQSEEEASVNLNAINQCPLHKPWALTFSYGRALQASALKAWGGKKENGKACQEEFVKRALANSQACVGKYVSSGVSAAGGESLYVANHAY

SEQ ID NO: 2229 - protein, 1120 aa, Oreochromis niloticus
MPEPVPEGKPAVDAPAEDGADSETDGDEPQSTELTGLFVEKPPNSVVAVAGTDVTFIAKVDSTSLTRKPTMKWLKGKWLDLGSKAGKHLQFKETYDRNTKIYTYEMKIIKVVPGDAGGYRCEVTSKDKCDSSTFEISVEAAHQDEQADILSAFKRADAGEDEGDLDFSALLKAAKKKKKPEKEEPEIDVWELLKSAHPSEYEKIAFKYGITDLRGMLKRLKKMKAEPIVHSEAFLKKLESCYSVDKGKKITLRCEVVDPNVQVKWLKNGQEIKPSAKYIMEASGNVRTLTINKATLADDAAYECVVGEDKSFTEVFVKEPPVTITKLMDDYHVVVGDRVEFEIEVSEEGAHVMWFFEDQEIHKDKDSKYRFKKDGKKHTLIIQEATLDDIGMYHAWTNGGHTKGELEVEEKELEVLQDIADLTVRATDQAMFKCEVSDDKVTGKWYKDGVEVLPSERIKMTHIGRFHRLIIDNVKPEDAGDYTFVPDGYALSLSAKLNFLEIKIDYVPRQEPPKIHLDTTGNMVSQNTIIVVAGNKLRLDVEITGEPAPTVVWSKGDKPITDTEGRVRVEARKDLSCFVIEGAERDDEGNYSITVTNPAGEDKAVLFLKIVDVPDPPENIKCTGVGEDCASIVWDPPKFDGGAPVKGYLMERKKKGSSRWTKLNFDVYESTTYEAKRMIEGVLYEMRVFAVNSIGMSQPSLSSKPFMPIAPTSEPTRLTVHDVTDSTCSLKWLAPEKIGAGGLDGYVIEYCKEGDTEWVVANQELCERQGYVVRGLPVGEKINFRVVAVNMAGRSPPALMSQPVTIREIVEHPKIRLPRDLRTKYIRRVGEKINLTIPFQGKPRPIATWFKDGKPLDEKIVNVRNSNVDSILFIRSAEREHSGTYELVLKIENMEDRASINIRIVDKPGPPLNVRATDIWGFNAALEWEPPKDDGNCDISGYTIQKADMKTKEWFTVYEHNRRTNCTVSDLVMGNEYMFRVYSENLCGLSEEPRMSKNTAVIAKTGLELKSKPYKEKDMCCSPKFTQPLVDRSVVAGYSTAISCAVKGFPKPKIVWMKNKMIIGEDPKYLMQNNQGVLTLNIRKPSTFDGGKYSCMAVNELGKDEVECTLNVRVYKEPEK

SEQ ID NO: 2230 - protein, 842 aa, Oreochromis niloticus
MSKPLSDHDRRKQISVRGLAGVENVSDLKQNFNRHLHFTLVKDRNVATRRDYYFALAHTVRDHLIGRWIRTQQYYYEKDPKRVYYLSLEFYMGRTLQNTMVNLGLENACDEAMYQLGLEMEELEDMEEDAGLGNGGLGRLAACFLDSMASLGLAAYGYGIRYEFGIFNQKIVNGWQVEEADDWLRYGNPWEKARPEYMRPVHFYGRTEHHPDGVKWVDTQVVLALPYDTPVPGYRNNIVNTMRLWSAKAPCDFNLKDFNVGGYIQAVLDRNLAENISRVLYPNDNFFEGKELRLKQEYFVVSATLQDIIRRFKVSKFGSREIARTDFSKLPDKVAIQLNDTHPAMAIPELMRVLVDEEKLNWETAWDICVRTCAYTNHTVLPEALERWPVELFAHLLPRHLEIVYEINRRHLERVAAKYPGDVDRLRRMSLIEEGGQKRINMAHLCIVGAHAVNGVAQIHSDILKATVFKDFYEMEPHKFQNKTNGITPRRWLVMCNPGLAEAIAERIGEDFIRDLDQLRNLVKFVNDEAFIRDIAKVKQENKMKFAVHLEEHYKVKINPNSMFDIQVKRIHEYKRQLLNCLHIITYYNRIKKDPNKQWTPRTVMIGGKAAPGYHTAKMIIRLITAIGEVVNNDPVVGDRLKVIFLENYRVTLAEKAIPAADLSEQISTAGTEASGTGNMKFMLNGALTIGTMDGANVEMAEEAGEGNLFIFGMRVDDVEALDNRGYHAEEYYNRLPELKQAIDQIAGGFFSPKQPDLFKEIVNMLMHHDRFKVFADYEDYIKCQEKVNALYKNPKEWTKKVIYNIAGCGKFSSDRTIAQYAREIWGVEPTLEKIPAPDDKH

SEQ ID NO: 2231 - protein, 333 aa, Oreochromis niloticus
MVKVGINGFGRIGRLVTRAGFHSKKVEIVAINDPFIDLEYMVYMFKYDSTHGRYKGEVKAEGDKLVIDGHKITVFHERDPANIKWGEAGAEYVVESTGVFTTIEKASTHLKGGAKRVIISAPSADAPMFVMGVNHEKYDNSLKVVSNASCTTNCLAPLAKVINDNFGIIEGLMSTVHAITATQKTVDGPSGKLWRDGRGASQNIIPASTGAAKAVGKVIPELNGKLTGMAFRVPTPNVSVVDLTVRLEKPAKYDDIKKVVKAAAEGPMKGILGYTEHQVVSTDFNGDCHSSIFDAGAGIALNDHFVKLVSWYDNEFGYSNRVCDLMAHMASKE

SEQ ID NO: 2232 - protein, 5072 aa, Oreochromis niloticus
MAEGGEGEEEIQFLRTDDQVVLQCTASVLKEQIKLCLSCEGFGNRLCFLETTSNAQNVPPDLAICTFILEQSLSVRALQEMLANTVEMTESSQGGGHRTLLYGHAILLRHHHSGMYLSCLTTSRSLTDKLAFDVGLQEDSTGEACWWTIHPASKQRSEGEKVRVGDDLILVSVSSERYLHLSYASGDLMVDASFMQTLWNMNPISSGCELAEGYLTGGHVLRLFHGHMDECLAIATPEEGEEKRRMAHYEGGTVCSQARSLWRLEPLRISWSGSHMKWGQSFRIRHITTGRYLCLDEEKGLLVVDPEKANTKLSAFCFRASKEKVDVAQKRDVEGMGIPEIKYGESMCFVQHVSTGLWLTYAALDAKAARLGMMKRKVILHQEGHMDDALTVSRSQTEESQAARMIYSTTGLFRQFINGLDSLSGKNKSLGTGSLPLESVILSLQDLIFYFRPPEEELEHEEKQTKLRSLRNRQNLFQEEGMITIVLECIDRLNVYNTAAHFSEFAGEEAAESWKEIVNLLYELLASLIRGNRSNCALFCDNLDWLVSKLDRLEASSGILEVLYCVLIESPEVLNIIQENHIKSIISLLDKHGRNHKVLDVLRSLCVCNGVAVRSNQNLITENLLPGRDLLLQTNIVNYVTSVRPNIFLGTCEGSTQYKKWYYEVMVDHVEAFVTAQASHLRVGWALTEGYSPYPGGGEGWGGNGVGDDLYSYGFDGLHLWSGTVARQVASPSAHTLAADDVVSCCLDLSVPSISFRINGHPVQGMFENFNVDGLFFPVISFSAGVKARFLLGGRHGDFKFMPPPGYAPCYEALLPRERMRIEHIKEYKHDFDGVRNLLGPTLSLTHTSFTPCPVDTIQIVLPPHLERIREKLAENIHELWAVTRIEQGWTYGIFRDDNKKLHPCLVDFQSLPEPEKNYNLQMSAETLKTLLALGCHVGMGDEKAEENLKKIKLPKTYVMSNGYKPAPLDLNHVKLTPNQNQLVEKLAENGHNVWARDRVRQGWTYSIVQDIVNKRNPRLVPYNLLDERTKKTNRDSVNNAVRTLIGYGYNIEPPDQESTGHGLENTRGDKVRIFRAEKSYAVTQGKWYFEFEAVTTGEMRVGWARPNVRSDTELGADELAYVFNGNKAQRWHIGNEPFGRQWQSGDVVGCMIDLTEMNIMFTLNGEMLISDSGSEMAFKDIEIGDGFIPVCTLGLSQVGRINLGQNVSSLRYFAICGLQEGFEPFAINMKRDITMWFSKSLPQFVPVPADHNHIEVSRVDGTVDSAPCLKLTHKTFGSQNANTDMMFLRLSMPVQFHETFKIPAGTTPLTRALTIPEEEVAVVEPDSEFEVLKKSASRKEQEEDKKDPSVPKEISVENEKDTMSEKGKKKGFFSKAKKAAMTPLAPPPAPPTVPRLVEDVVPDDRDDPEIIQSTTTYYYSVRIFAGQEPSGVWVGWVTPDYHMYDQNFDLSKVRSVTVTVGDDKGNIHDSMKHSNCYMVWGGDLVSNQQTRFSQEDMVIGCLVDLATGLMTFTANGKEINTFYQVEPNTKLFPAVFVQPFSQNMVQLELGKLKNIMPISAAMFRSERNNPVPQCPPRLDVQMLTPVIWSRMPNHFLKPEVGKVNERLGWMVECVEPLIMMALHIPEENRCIDILELSERQDLMKFHYHTLMLYCAVCALGNNRVAHALCSHVDESQLFYAIENTYLPGPLRSGYYDLLISIHLESAKRARLGTNREFIVPMTEETLSIKLYPDAIKAHSLPGVGLTTCLRPKLHFSSINFVGTDPDLYTISPVFPLQELKTKAISMLREAVLDGSQAMRDPVGGSVEFHFVPILKLISTLLIMGIFNDDDTKHILKMIDPNVFSGKEEEEAEEGGAAEGENEEKKEEESEEAAEDELEDEGVGDEEEEELKELEKPEGEEEEAEPKEEGEEGEKDKEEAKRGKVDGEKAEEEKESEAVEAEAQEEEEGLEEGLLQMTLPESVKLQMCTLLQYFCDCELRHRVEAIVAFSDQFVHDIKSNQRVRYNQLMRAFTMSAAETARKTREFRSPPQDQVLMLTNFKHQEDEDSPVPEDVRETLAEFHKDLLLHCGIHIEEEPEEEEVDTSLRGRLLSLVDKVKSLRKKKEEEEKPEVEEEPKPSTLQELISHTMIHWAQESFVQNPELVRLMFSLLHRQYDGLGELIRALPKAYAINAVSVQDTMELLECLGQIRSLLIVQMGPEEERLMIQSIGNIMNNKVFYQHPNLMRALGMHETVMEVMVNVLGGGGDSKEIRFPQMVTSCCRFLCYFCRISRQNQRSMFDHLSYLLQNSGIGLGMRGSTPLDVAAASCIDNNELALALQEQDLEMVVTYLAGCGLQMCPMLLSKGYPDIGWNPCGGERYLDFLRFAVFVNGESVEENATVVVRLLIRRPECFGPALRGEGGNGLLAAMEEAIKISEDPARDGPTVKKDRRFMFGGEEQHEENRVHLGNAIMSFYSALIDLLGRCAPEMHLIQAGKGEALRIRAILRSLVPIEDLVGVISLPVQIPAYGKDGQIIEPKMSASFVPDHKASMVLFLDRVYGIDNQDFLLHVLEVGFLPDMRAAASLDTVAFSTTEMALALNRYLCSAVLPLLTKCAPLFAGTDHRAIMIDSMLHTIYRLSRGRALTKAQRDVIEECLMSLCKYLRPSMLQHLLRRLVFDVPILNEYAKMPLKLLTNHYERCWKYYCLPNGWANFGVTSEEELHLSRKLFWGIFESLAHKKFDAELFKIAMPCLCAIAGAIPPDYVDASYSSHTEKKASVDAEGNFDPKPVETTNTIIPERLDPFVNKYAEHTHDKWAFEKIQNNWTYGEVLDENAKTHPMLRPYKTFSEKDKEIYRWPIKESIKAMLAWEWTIEKARDGEGEVEKKAAATTTTRKISQTAQATYDPSHGYSPQPIDISGMALSRELQSMAEQLAENYHNTWGRKKKLELQSKGGGTHPLLVPYDTLTAKEKARDREKAQDLLKFLQLNGYAVTSPRGLKDMEQDISSIEKRFAYGFLQKLLKWMDIAQEFIAHLEAVVSSGRVEKSPHEQEIKFFAKILLPLVNQYFKNHCLYFLSTPAKVLGSGGHSSNKEKEMIASIFCKLAALVRHRVSLFGTDAPAVVNCLHILSRSLDARTVMKSGPEIVKAGLRQFFESAADDIEKMVENLKLGKVSSRNQVKGVAQNINYTTTALLPVLTSLFDHIAQHQFGDDVMLDDLQISCYRLMCSIYSLGTVKTPHVEKQRPALGECLAHLAAAMPVAFLEPVLNEFNSFSVYTTKTPRERAILGLPNQVEELCPDIPELEILMKEIHDLAESGARYTEMPHVIEITLPMLCNYLPRWWERGPESFPEQDGQLCTAVTSEQLNQLLGSIMKIVVNNLGIDEASWMKRLAVFAQPIVSRAKPEMLKSHFIPTMEKLKKRAAKVVAEEDHLRMEGKTEVDSENGTIRDEFAVLCRDLYALYPLLIRYVDNNRARWLTCPDPDAEELFRMVGEVFIFWSKSHNFKREEQNFVVMNEINNMSFLTADSKSKMSKAGDGESGGSEQERTKKKRRGDRYSVQTSLIVAALKKMLPIGLNMCSPADQELINLAKIRYSLKDTDEEVREFLHNNLHLQGKVEDPAMRWQMSLYKEMSGKAEDADDPEKVVKRVQEVSAVLYHIEVTEHPFKSKKMVWHKLLSKQRRRAVVACFRMTPLYNITTHRVTNMFLDAYKRNWLETEGYSFEDKMIDDLSKAMEEEEEEEEETETKPDPLHQLILHFSRTALTEKLKLDVDHLYMSYADIMAKSCHIGEEDEGGEQEGEEPSFEVRQTEMEKEMEKQRLLYQQSRLHNRGAAEMVLQMISACKGEPGAMVSSTLKLGISILNGGNSDVQQRMLDYLKDKKDVGFFLSVQSLMQTCSVLDLNAFERQNKAEGLGMVSEEGTNEKVMADDEFTCDLFRFLQLLCEGHNNDFQNYLRTQTGSTTTINVIICTVDYLLRLQESISDFYWYYSGKDIIDEPGKRNFSKAMTVAKQVFNSLTEYIQGPCTGNQQSLAHSRLWDAVVGFLHVFAHMMMKLAQDSSQIGLLKELLDLQKDMVVMLLSLLEGNVVNGTIARQMVDMLVESSSNVEMILKFFDMFLKLKDIVASDAFRDYVTDPRGLISKKDFSKAMDSQKQYSPSEIQFLLSCSEADENEMINFEEFADRFQEPAKDIGFNIAVLLTNLSEHVPHDTRLQNFLEQAESVLNYFRPFLGRIEIMGASRKIERIYFEISEENRNQWEMPQVRESKRQFIFDVVNEGGESEKMEMFVNFCEDTIFEMNIAASISEPEGDGAEEEDDEEEEEGGGDEGESGEGDEGNGEGEAPESASAFAEFLKSVVNFFNMFTFRNLRRRYRKLRKMTVKDMIIGLVTFVYTVLMGILMFVYSICKGFFTLIWKALFGGGLVEGAKKMTVTEILASMPDPTQDEVHGDLPPEPGAREVQDADGVADLIDAVGGEEEEEDGEDREGGRLPGFNTPGGLGDMGETTPEEPPTPEGTPLLKRKLLAAAVGGQEEEEKGEHEEEAPQETEKADTENGEKTEKAEKAEPEPEVKEEEPEEQEEISVKTKVKKDKKSVKEGFKLWNELEVQRIKFMNYLSRNFYNLRFLALFIAFALNFILLFYKVSDTPPGEEEFEGSGLFEGSGIFEGSGAEEDGSGLDDGGDDDDEEGPLYYFLEESTGYMEPAMAFLGIVHTIISFLCIIGYNCLKVPLVIFKREKELARKLEFDGLYVTEQPEDDDIKGQWDRLVLNTPTFPNNYWDKFVKRKVLDKYGDIYGRERIAELLGMDLASLDVSAMSHGKKPEPDTSMFSWITSIDIKYQIWKFGVVFTDNTFLYLVWYMLMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVREDMETKCFICGIGSDYFDTTPHGFETHTLEEHNLANYMFFLMYLINKDETEHTGQESYVWKMYQERCWDFFPAGDCFRKQYEDQLG

SEQ ID NO: 2233 - protein, 738 aa, Oreochromis niloticus
FLLLKLSVCITETDDKMRAFAEQVFASETKDETVRDEISMFDVAEDCPIIHHEMAHHLHTDDDEQKRKKRSRTMAVPTVASQAAATPVVSVEVDTPTYLEVPDFQRVAVIGDYAAGVTMDDFELACRGLYRALTIREKYMRLAFQRFPRTASQYLRQIEGESFRPEEQLEPVFTSPPKEGEDPFDVKNLPKNLGYVARMKDGVIYVYNDAAAADKHKPKDTPYPDLNTFIDDMNFLIALIAQGPTKTYTHRRLKFLMSKFNVHEMLNEMEEMKEVKKNPHRDFYNCRKVDTHIHAAACMNQKHLLRFIKKSYRVDAERVVHNLKGKEVTMKELFQSLNLHPYDLTVDSLDVHAGRQTFQRFDKFNAKYNPVGASELRDLYLKTENHINGEYFATIIKENQEVANDLEEAKYQYAEPRLSIYGCNANEWNKLSNWFVRHRVYSPNLKWMIQVPRIYDIFRGRNFVPHFGKMLENIFLPVFQATIDPQSSPELSIFLKHVTGFDSVDDESKHSGHMFSTKSPKPEEWDIAKNPSYTYYIYYMYANIAALNQLRKQRGMNTFMFRPHCGEAGAITHLLAAFMTADNISHGLNLKKSPVLQYLYVLSQIPIAMSPLSNNSLFLEYAKNPLLEFHKKGLVVSLSTDDPMQFHYTKEPLMEEYAIAAQVFKLSTCDMCEIARNSVLQSALSDEEKRHFLGKDYLKEGPEGNDIRKTNVPQIRMAYRYETLCYELNLIKEGLKSE

SEQ ID NO: 2234 - protein, 434 aa, Oreochromis niloticus
MSITKIHAREILDSRGNPTVEVDLWTAKGLFRAAVPSGASTGVHEALELRDGDKSRYLGKGTVKAVDHVNKEIAPKLIEKKFSVVEQEKIDKFMLELDGTENKSKFGANAILGVSLAVCKAGAAEKGVPLYRHIADLAGHKDVILPVPAFNVINGGSHAGNKLAMQEFMILPVGASNFHEAMRIGAEVYHNLKNVIKAKYGKDATNVGDEGGFAPNILENNEALELLKTAIEKAGYPDKIIIGMDVAASEFFRNGKYDLDFKSPDDPSRHITGEKLGDLYRSFIKNYPVQSIEDPFDQDDWEHWAKFTSSVDIQIVGDDLTVTNPKRIQQAVDKKACNCLLLKVNQIGSVTESIQACKLAQSSGWGVMVSHRSGETEDTFIADLVVGLCTGQIKTGAPCRSERLAKYNQLMRIEEELGDKAKFAGKDFRHPKIN

SEQ ID NO: 2235 - protein, 322 aa, Oreochromis niloticus
MTVGCVAGDEESYEVFKDLLDPVISDRHGGYKPTDKHKTDLNFENLKVQGGDDLDPNYVLSSRVRTGRSIKGFTLPPHNSRGERRAIQNLSIEGTALSSLEGEFKGKYYPLDGMTDAEQEQLIADHFLFDKPVSPLLTCAGMARDWPDARGIWCRHNDNKTFLVWVNEEDHLRVISMQKGGNMKEVFRRFCVGLQKVQIEEIFKKHNHGFMWNEHLGYILTCPSNLGTGLRGGVHVKLPKLSTHPKFEEILTRLRLQKRGTGAGGVDTASVGGVFDISNADRLGSSEVEQVQLVVDGVKLMVEMEKKLEKGESIDGMIPAQK

SEQ ID NO: 2236 - protein, 1485 aa, Oreochromis niloticus
MSASLQVTQKLQHQHQHQHEEKQQQQHHYESSYYLSSKSSVSKQSFSTVKTTSHRKKISVKTEKGQEVVKLSPLPKRAKRTYLAMDKDKEVIGYVIPVFRASHDVVRGLMEAQEEEVTEEGINYVAMRNLFVREAREAMEVKVEKKTRSKHVRESAVRLEMSRTMEEWLEFRKKMNPDSLTHRPEFIVKPRGQTVWEGKDVKLHCTVAGWPKPRIAWYKNNVLIDAKAHPEKYTAESNYNMHSLEIKNCDFFDTAKYHVSALNVKGETSAVASVVVKRFQEGVEPGPLDPKPHGFSPEHGVTFETTIIDKFEVAFGSEGETLSLGCTVIIYPTVKKYQPEVVWYRNSVPLKPSKWVHTHWSGERAVLTLVHLNKEDEGMYTLRVNTKSGYDTYAAYVFVRDADVEVEGVPVAPLDVRCHDANKDYVVVTWKQPAVEGSSSILGYYIDRCEVGTHHWAQCNEVPVKYARFPVTGLVEGRSYVFRVRAVNKAGVSRPSRISEAVVAMDPSDRARLRAGPSAPWTGMIKFTEEDPTVGVVPGEPTDVVVTEATKSYVVLAWKPPAQRGHEGVMYYIEKRISGTDTWQRVNTGMPVKSPRFALFDLAEGKSYSFRVRCCNSAGVGEASESTGEVIVGDKLDLPSAPGNPVATRNTDTSVVVFWGASKDVQHLVGYYIECSVVGTDVWMPCNNKPVKQTRFVCHGLITGANYVFKVKAVNAAGYSQSSPNSDAVVVQAAISVPGKPTGVTLLEAFKDYMVLGWNAPANNGGADIRGYFVDYRTVKGGVAGKWHEMNHQALTTTSYKAENLKERLFYQFQVRAVNMAGVSKPSLPSAPLECKEWTITVPGVPVGLHVLEIRDTSVVVLWEPPVFDGRSPVNGYYLDVKEASAGEECWKGVHEKVNKMKYMKVTGLKGGASYVFHVRAQNLVGVGKPSAVLGPILAQTRPGTKEIYVDVDDDGVISMVFECSEMMEGSEFVWSKNYKEITDTSRLTIISERGKSRAIFNSPSLEDLGTFSCVVTNTDGISSSYTLTEEGLKRLLDISHDHKFPVIPFKNEMAMELLEKGRVRFWTQVEKCTSDCQVEYVFNDVIISQGKKYTMNFDKSTGIIEMFMDSLEVTDEGTFTFNLVDGKAKGTTSLVLIGDEFRELQKKSEFARAEWVRKQGPHFVEYLDFSVTPDCDVLLKCKIGNVRPETEITWSKDCIEIAEDDEDAKKIERQDGELTFNIGKISKHDAGVYEVFLKDERGRDKSTFNLTDAGYQAVMNELFRVIANSSSEIKVLSTEHGIVLYSTVTYYHEDLRVGWLHKDGKIAASERVKSGVTGDQLWLKINEPTEKDKGKYSMDIFDGKDGVKRAFDLTGQAWQEAFEEFQRLKAAAIAERNRARVVGGLPDVVAIQEGKSLNLTGNVWGEPVPEVSWTKNEKQLVSDDHYKLKFEHNKFASITIAAVTTADSGKYALVVKNKYGTEAGEFTVSVYNPEEEESKEEKKD

SEQ ID NO: 2237 - protein, 173 aa, Oreochromis niloticus
IKQTHLRGRKRRRRHSQRQTSSADMERTFIAVKPDGVQRGLCGEIIKRFEHRGFRLVAAKFVQASEDHMKKHYLDLKDMPFYAGLCKYMSSGPILAMVWEGQNIVKLARMMLGETNPADSKPGSIRGDLCINIGRNIIHGSDTLENAKMEVDLWFKPEEFVTYTPCAQSWLYE

SEQ ID NO: 2238 - protein, 227 aa, Oreochromis niloticus
MSDTEEVGVEEEKPKFKPTAPKIPEGEKVDFDDIQKKRQNKDLMELQALIDAHFEHRKKEEEELIALKERIEKRRAERAEQQRVRAEKEKERQARREEERRIREEADAKKKADEDAKKKSALSSMGSQYSSHLQRADQKRGGKKETEREKKKKILAARRKPLNIDHLNEEKLKEKIKELHDWMAQLESEKFDHTERLKRQKYEVTTLRKRIEELSKFSKKGAARRRK

SEQ ID NO: 2239 - protein, 170 aa, Oreochromis niloticus
MAPKKAKRRQAAGDSGSSNVFSMFEQSQIQEYKEAFTIIDQNRDGIISKDDLRDVLASMGQLNVKNEELEAMIKEASGPINFTVFLTMFGEKLKGADPEDVILSAFKVLDPAATGTIKKEFLEELLTTQCDRFSKEEIKNMWAAFPPDVAGNVDYKNICYVITHGEEKEE

SEQ ID NO: 2240 - protein, 1262 aa, Oreochromis niloticus
HCTVSGWPDPRVVWYKNNVALDPLANPGKYKIESRYSVHSLEINKCDFDDTAQYRVSAMNAQGELSAFASVVVKRFKGEIDEFLPAPRRKPLESKICQTHIVDKFGVSFGREGETMSLGCTVIIYPALHRYQPEVEWYRDDVLLSPSKWTHMHWSGDRATLTLTHLNKEDEGLYTLRVTTKSGYETYSAYVFVRDADAEVEGAPAAPLDVRCLDANKDYIIVAWKQPAVDGGSSILGYFVDRCEVGTTHWIQCNDTPVKFARFPVTGLVEGRSYIFRVRAVNKSGISRPSRVSEPVAAMDPADRARMRGTSAPWTGQIIVTEEEPAGKGIVPGKPLDLQVTEATKNYVVLSWKPPGEKGLEGVMYYVEKCVSGTDSWQRVNTEIPVKSPRFALFDLAEGKAYRFRVRCCNSAGVGEPSDPTEATTVGDKLDIPSAPGKVIPTRNTDTSVVVSWEASRDAKELVGYYIEGSIVGSNVWEPCNNKPVNVTRFICHGLITGEKYVFRVRAVNAAGISQFSQESEAVEVKAAIASPAPPYGITVLECVRDSMVLAWKQPTFIGGADITGYFVDYREVIDGVPGKWHEANIKAVSERAYRVSDLKENKKYQFQVRAANMAGVGIPSLPSNTFLCEEWTIAVPGPPYDLQIREVRNDSLVLLWKPPVYQGRDPVNGFYVDIKEADAPEEAWRGVNTKALEKTYTKIKDLKEGEKYVFRVRAQNKAGVGKVSDVTEPVPALTKPGTKEIVVDVDDDGVISLNFECGNMTPDSKFVWSKNYEEITDTSRLSTETKGTKSKVVFNRPGEEDIGVYSCLVTHTDGASSSYTLSEEELKRLLEISHDHKFPIIPLKSDLAVELLEKGRVRFWLQAEKMSNNGKVDYVFNDNVVSQGEKYKMNFDKNTGVIEMTMESLTPADEGTYTFQLQDGKATNQSSLVLIGDVFKQLQKESEFQRKEYFRKQGPHFIEYLSWEVTPECCVVLKCKVGNMKKETSALWHKDRHQIKVDEHLGFAEGVLKLEIAQISKKDAGVYEVILKDDRGQDTSTLNLTDQGFKDLMNEVFSVIANSSTPLKITSTDEGIRLYTFVSYYNDLLQVTWHYKDSAIAFSDRIKSGVVGEQLWLQIKEPTEKDMGKYAIEFYDGKGGLRRTVDLSGQAFDDAFAEFQRLKAAAIAERNRARVAGGLPDVVTIQEGKALNLTCNISGNPVPEVTWLKNDREITSDEHCILKFESGKFASFTITGVNTSDSGKYSILVKNKYGTESGDFTVSVF

SEQ ID NO: 2241 - protein, 169 aa, Oreochromis niloticus
GPHCLGTSASHLLQLLLSKMTEFTPDQIEDFKEAFGLFDRVGDSQVAYNQVADIMRALGQNPTNKSVNKILGNPSADDLANKRLNFDAFLPMLKEVDAQPKGTYDDYVEGLRVFDKEGNGTVMGAELRIVLSTLGEKMNEQEIDALMAGQEDENGSVHYEAFVKHIMSV

SEQ ID NO: 2242 - protein, 305 aa, Oreochromis niloticus
MPLGTPAPLTKRKKPSKIITDLSHIPQDEYESEPEASEFDLGTKIRTPKDIMLEELSLLKNRGSKMFRMRQQRVEKFIYENNPDVFSSESMDNLQKFVPSLGGQVGGQIINLGGHFVSKESGRLNFVGLQTGGGAPVPPPKPGSKGAGGSGGAGGAGSAGGVGVGEKGGKGEGGGKHDGTKKQIHVKTYVSPWEKAMKGDETLLATLKTNMPHPNAKKELPQYKCFNRSAMPYGGFEKANQFLKFQLPEAEATKEEPEPAVVYHHDISCRPSFNRTPIGWVGSSEPSSIHMETDAVPFDGETDEL

SEQ ID NO: 2243 - protein, 475 aa, Oreochromis niloticus
MSKSYASSAQSASSYRRTFGSGVGSTPLSSMFSSSLGGAHSSASSRMSSRVYEVKSTGIPSYSSFKLSSGAGLGSSTAMRTYAGEKLDFNLADAMNQDFLNTRTNEKAELQHLNDRFASYIEKVRFLEQQNAALTVEIEKLRGREGPGRVAELYEEEMRELRRQIEALTNQRARVEVERDNLADDLQKLKLRLQEEIHQKEEAENNLSAFRADVDSATLARLDLERRIESLQEEIAFLKKIHEEEIRELQSQIQDTQVQIQMDMSKPDLTAALRDIRMQYEAIAAKNIAEAEEWYKSKVSDLNQAVNKNNDALRQAKQETMEFRHQIQSYTCEIDSLKGTNESLLRQMRDMEDRMAREATGYQDTITRLEEDIAKMKDDMARHLREYQDLLNVKMALDIEIATYRKLLEGEESRITTTIPVQSAYSSIGFRETSPESQHQRSSEVHSKKTVLIKTIETRDGEVVSESTQHQQDIM

SEQ ID NO: 2244 - protein, 1080 aa, Oreochromis niloticus
MLSFVDTRILLLLAVTSYLASCQCKGPKGPRGDRGPPGPNGKDGLPGPPGPAGPPGPPGLGGNFAAQYDGVKAPDPGPGPMGLMGPRGPPGPPGASGPQGHTGHAGEPGEPGQAGAVGPRGPPGPPGKAGEDGNNGRPGKPGDRGAPGPQGARGFPGTPGLPGMKGHRGYTGLDGRKGEPGAAGPKGEPGAHGAAGSPGLAGARGLPGERGRPGPAGPAGARGADGNAGPTGPAGPLGAAGPPGFPGGPGPKGETGPVGATGPSGPQGSRGEPGPNGAVGPVGPSGNPGANGLNGAKGAAGTPGVAGAPGFPGPRGGPGPQGPQGAAGPRGLAGDPGIQGVKGDSGPKGEPGHSGPQGPPGPQGEEGKRGPTGEIGATGLAGARGARGAPGSRGMPGAEGRTGPVGMPGARGATGAAGPRGPPGDAGRAGEPGAAGLRGLPGSPGSSGPPGKEGPAGPSGQDGRSGPPGPSGPRGLSGNIGFPGPKGPSGEPGKPGERGATGPTGLRGPPGPDGNNGATGATGVAGGPGEKGEQGPSGSPGFQGLPGPAGPAGEAGKPGDRGIPGEPGAAGNAGAKGERGNPGAAGSAGPQGPIGPRGPAGAPGPDGGKGEPGRLGPAGPPGARGAPGNIGLPGMTGPQGEAGREGSPGNDGPPGRPGAAGLKGDRGEPGSAGTTGLAGAPGPAGPTGAAGRPGNRGEAGPSGPSGAVGPAGARGASGPAGPRGEKGVAGDKGERGMKGLRGHPGLQGMPGPSGPPGDTGAAGAHGPSGPRGPAGPHGPVGKDGRPGAHGTMGAPGARGPNGYSGPVGPPGPPGLPGPPGPAGGGYDVSGGYDEYRADQPALRAKDYEVDATIKSLNTQIENLLTPEGSRKNPARTCRDIKLSHPDWSSGFYWIDPNQGCTNDAIKVFCDFTTRETCIYAHPESIARKNWYRSTENKKHVWFGETINGGTEFTYNDETLSPQSMATQLAFMRLLSNQASQNITYHCKNSVAYMDGESGSLKKAVVLQGSNDVELRAEGNSRFTFSVLEDGCTTHTGEWSKTVIEYRTNKPSRLPILDIAPLDIGGADQEFGLDIGPVCFK

SEQ ID NO: 2245 - protein, 193 aa, Oreochromis niloticus
MAPKKDAKAPAKKAEPAPAPAPAPAPAPAPAPAAPAVDLSAIKVEFSADQIEDYREAFGLFDRVGDNKVAYNQIADIMRALGQNPTNKEVNKLLGNPSADDMANKRVEFEGFLPMLQAIINSPNKAGFEDYVEGLRVFDKEGNGTVMGAELRIVLSTLGEKMTEAEIDALMAGQEDENGCVNYEAFVKHIMSV

SEQ ID NO: 2246 - protein, 281 aa, Oreochromis niloticus
MSTYTVSLNGPAPWGFRLQGGKDFNMPLTISRITPGSKAAGGSLTQGDIISAIDGVSTEGMTHLEAQNKIKSATTKLTLSMQKSRRPAPVPTATPRMDSPMPVIPHQKVIANTAANVEYTPSFNPIALKDSALSTHKPIEVKGPGGKATIVHAQYNTPISMYSQDAIMDAIAGQSQAKGHDSGVLPIKEPVVDCASPVYQAVIRPGEPQDMTDWARRAANLQSKSFRILAHITGTEYLQDPDEEALQKSREKFESEVKGPRFAKLKNWHHGLSAQILNVQE

SEQ ID NO: 2247 - protein, 778 aa, Oreochromis niloticus
MAQQSPTDPTKMGVGRAIAVLTSGGDAQGMNAAVRAVVRVGIYTGAKVFFVHEGYQGLVDGGDHIRPATWESVSMMLQLGGTVIGSARCQDFRTKEGRTKAACNLVKLGITNLCVIGGDGSLTGANQFRTEWSELLADLVKAGKITANEAKSASHLNIVGMVGSIDNDFCGTDMTIGTDSALHRIIEIVDAITTTAQSHQRTFILEVMGRHCGYLALVTALACGADWVFIPEMPPDDGWEEHLCRRLTEQRGRGSRLNIIIVAEGAMDRQGKPITCDHVKQLVSKKLGFDTRTTILGHVQRGGTPSAFDRILASRMGVESVMALLEATPETPACVVSLSGNMAVRLPLMECVQVTKDVTTAMAEGRYDDAVKLRGKSFENNWNTYKMLAHVRPPEAKSNINIAILNVGAPCSGMNAAVRSAVRTGLLQGHQMMAVHDGFDGLAHGVIEPIGWSGVAGWTGKGGSFLGTKRSLPQEFMEEISLSITKFNIHALIIIGGFEAFMGGLQLVQAREKYEELCIPLVVVPATVSNNVPGSDFSIGADTALNTITMTCDRIKQSAAGTKRRVFIIETMGGYCGYLATMAGLAGGADAAYIYEDPFNIHDLELNVEHLVEKMKTTVKRGLILRNEKCNANYTTDFIFNLYSEEGKGVFDCRKNVLGHMQQGGTPSPFDRNFGTKMGMKSVLWLTDKLKECYRHGRIFANSQDSACVLGMRKRALVFQPLAELAEQTDFDHRIPKTQWWLRLRPILKILAKYKVSLDTSEKTAMEHVIKKRGLVKQ

SEQ ID NO: 2248 - protein, 1291 aa, Oreochromis niloticus
MFSFVDLRLALLLSAAVLLVRAQGEDDRTGKSCTLDGQVFADRDVWKPEPCQICVCDSGTVMCDEVICEDTTDCPNPIIPHDECCPICPDDGFQEPQTEGTVGARGPKGDRGLPGPPGRDGMPGQPGLPGPPGPPGPPGLGGNFSPQMSGGYDEKSPAMPVPGPMGPMGPRGPPGPPGSSGPQGFTGPPGEAGEPGSPGPMGPRGPAGPPGKNGEDGESGKPGRPGERGPPGPQGARGFPGTPGLPGIKGHRGFSGLDGAKGDTGPAGPKGEAGTPGENGTPGAMGPRGLPGERGRAGATGAAGARGNDGAAGAAGPPGPTGPAGPPGFPGGPGAKGDAGAQGGRGPEGPAGARGEPGNPGPAGPAGPAGNPGSDGAPGAKGAPGAAGVAGAPGFPGPRGPSGPQGAAGAPGPKGNTGEAGKPGERGTMGPTGPAGAPGKDGDVGAQGPPGPAGPAGERGEQGPAGSPGFQGLPGPQGAVGETGKPGEQGVPGEAGAPGPAGARGDRGFPGERGAPGAIGPAGARGSPGASGNDGAKGDAGAPGTPGAQGPPGLQGMPGERGAAGLPGLRGNRGDQGPKGADGTPGKDGPRGLTGPIGLPGPAGSPGDKGEPGAQGPVGPSGARGPPGERGEAGPPGPAGFAGPPGADGQPGAKGEPGDNGAKGDSGPPGPAGPTGAPGPQGPVGNTGPKGARGPAGPPGATGFPGAAGRVGPPGPAGNAGPPGPPGPAGKEGPKGNRGETGPAGRPGELGAAGPPGPPGEKGSPGADGAPGSAGIPGPQGIAGQRGIVGLPGQRGERGFPGLAGPVGEPGKQGPSGPSGERGPPGPMGPPGLAGAPGEPGREGTPGNEGAAGRDGAPGPKGDRGESGPAGAPGAPGPPGAPGPVGPAGKTGDRGETGPAGPAGAAGPAGPRGPAGAPGLRGDKGETGEAGERGMKGHRGFTGMQGPPGPPGTSGESGPAGAAGPAGPRGPSGAAGAPGKDGVSGLPGPTGPPGPRGRSGEMGPAGPPGPPGPPGAPGAPGGGFDLGFMVQPQEKAPDPFRMYRADDANVLRDRDLEVDSTLKSLSQQIEQIRSPDGTRKNPARTCRDLKMCHPDWKSGEYWIDPDQGCTQDAIKVYCNMETGETCVSPTQREVAKKNWYISKNIKEKKHVWFGEAMNEGFQFEYGSEGSLPEDVNIQMTFLRLMSTEASQNITYHCKNSVAYMDAAAGNLKKALLLQGSNEIEIRAEGNSRFTYSVLEDGCTSHTGTWGKTVIDYKTSKTSRLPIIDIAPMDVGAPDQEFGFEVGPVCFL

SEQ ID NO: 2249 - protein, 1451 aa, Oreochromis niloticus
MFSFVDIRLALLLSATVLLARGQGEDDSKYHFQTLICTLDGQLYNDKDVWKPEPCQICVCDSGTVMCDEVICEDTSDCADPIIPDGECCPICPDGTDHQFRALSTPVGPTGPKGDPGLPGYPGANGIPGDPGPPGPPGPPGPPGLGGNFSPQYSDPSKSSGPPVPGPIGPMGPRGPPGPSGPPGPQGFTGPPGEPGEPGASGPLGSRGPSGPPGKNGDDGEAGKPGRPGERGPAGPQGGRGFPGTPGLPGIKGHRGFSGLDGAKGDSGPAGPKGEPGTSGENGIPGALGARGLPGERGRPGAPGPAGARGNDGNTGPAGPPGPTGPAGPPGFPGGAGAKGETGAPGGRGSEGPQGARGEPGNPGPAGPAGPAGAPGSDGSPGSKGAPGAAGIAGAPGFPGARGPAGAQGAVGAPGPKGNNGDPGPSGPKGEPGAKGEPGPAGIQGLPGPSGEEGKRGGRGEPGGAGPRGPPGERGAPGARGFPGADGGAGGKGAPGERGAPGPLGAQGVTGESGSPGAPGAPGLKGVTGSPGSPGPDGKAGPAGAPGQDGRPGPPGPGGSRGQPGIMGFPGPKGASGDSGKPGERGATGPAGAVGAPGKDGDVGAPGPSGPAGPAGEKGEQGPAGSPGFQGLPGPQGSTGETGKPGEQGAPGEAGPSGPAGPRGDRGFPGERGGPGIAGPTGPRGAPGPAGNDGPKGEPGAAGAPGGLGAPGMQGMPGERGAAGLPGARGDNGEPGGKGVDGAPGKDGPRGLTGPIGVPGPPGAQGEKGEAGAVGVAGPSGPRGSPGDRGEPGPAGAAGFAGPPGVDGQPGAKGESGDSGPKGDAGPPGPTGPAGASGPQGPAGAPGPKGARGSVGSPGATGFPGPAGRVGPPGPAGAGGAPGPGGPTGKDGARGARGETGPAGRPGEAGAAGPPGPSGEKGSAGSDGAPGAPGIPGPQGIAGQRGIVGLPGQRGERGFPGLPGPSGEPGKQGSSGPVGERGAPGPAGPPGLSGPTGEAGREGSPGHDGAPGRDGPSGPKGDRGETGLAGPPGPPGAPGAPGGVGPSGKTGDRGESGPSGPAGPAGPAGVRGPAGPAGAKGDRGEAGEAGERGHKGHRGFTGASGLPGPAGPPGERGPAGASGPAGPRGPSGSNGAPGKDGVNGIPGPIGPPGPRGRNGEMGPAGPPGPPGPAGPPGPPGSGFEFVSQPLQEKAPDPLRGGHYRADDPNVMRDRDMEVDTTLKTLTQKVEKIRSPDGTQKSPARMCRDLRMCHPEWKSGMYWIDPNQGSPLDAVKVHCNMETGETCVYPSESTIPMKNWYLSKNIREKKHVWFSESMTGGFQFQYGSDGADPEDVNIQMTFMRLMSNQASQNVTYHCKNSIAYMDSATGNLKKALLLQGSNDVEIRAEGNSRFTYSVSEDGCTSHTGTWGKTVIDYKTSKTSRLPIIDIAPMDVGAPDQEFGVQVGPVCFL

SEQ ID NO: 2250 - protein, 1565 aa, Oreochromis niloticus
MSKKSKVTDQTATGQAGIRKKSKVPGVMITQFMEELPEGMTTPDFTRKPIALTIQEGKFAFFKAKIVGTPTPTVTWSRANGEILFHPAVCQQKYDEATEEHTLEFPKVAPEDADTYKCFATNEYGRAVCTVVLNVIEVGFSKTKELQKAQIEETIDFRKHLKKRNPDGTREHKTMETEEKVWEILLSADKKDYERICAEYGITDFRGMLKKLNEMKKEREEEIAEFVTHISSLKPIEVKDDDYATIELDMDLKDPSSKIYLYKDGVMVPFSKEEGDDLKHSLKQVGKKYIFKIKKLGTEDAGLYSVDVEGVNVFSTDFKVPPVDFAVKIQEIKAEEREDALFQCVLTAPMNEIKWYGKSALLSNSEKHEITVSEDKLIHKLIVRDCMPLDAGIYAAVAGIKSCNAWLIVEADKDPASKGKKAARKTTMAGGGNEEELLKIAKEQQEKYQKELEEKLELAKKAHAEKEAAGAATQEDEEAAKKAAAEAKAKAKAAARAKRAAAGKDGAPRKSKKKGAGAGSGAASADGTVGAGGAAGVGGAASAGGADGAVGAGGAAGVGGAAGAGGAGGAAGDGGAAGVGGAVGAGGAAGVGGAVGAGGAAGVGGAFGPGGAAGAGGTSGPGGAGGAAGAAGIGIAAGATAVAGAGSTSGIGAGGAGGAGIGVDGGASAGGQEGGHGAAAIGKGGAQGAAGVGVGGVEGEAFEEEDEYDSFEDSDEEFEGEWGEEGYVGGGGEEGEGGEGGEGGEGGEGGGKGGKRRKRVRAGPLVPDTVIDPGVHFHAGLSDCKAVIGEAAELECKVSSEDCVGVWYKDGEEIKSSEGLTISKDGTFHRLKIHKVTEEFAGKYKFEADGRKTEAEITVEDPPRFNAEDLKAFKTPVTVKKGHKATFNLAFIGREPIKIQWYREGEELSEDANIKIEHSEGSSRLLLLKLQRKDSGEIKFKLKNEFGTVEALSQLVVLDKPTPPMGPLETVEASSSAVEFKWRPPKDSGGCKILNYILERQQVGRNTWKKLGPIGPEAKYRDTDVDHGRRYCYRLRVETEMGISELMETEDIQAGTKAYPGPPSAPKVVSAFKDCITLSWSPPADTGGTGILGYNLEKRKKGSNLWGPVNPPNEMIRGKQFAVKDVVEGMEYEFRVSAINNSGAGEFSSPSEFVFARDPKKPPGKVSDFKVTDSTYTTISLSWTKPKDIVGVADEAKGYFVEIRLAENTEWDRCNLNAITMTSYTVKGMKSMGMYWVRVIAINEGGHGDPQELDNYHISMPPPVRPRFTDAKIKSFMVVRAGNSARFNINFEASPWPDVIWLKDGVPVSKKVTISNAEGTSQILIPSAERSDTGVYTIIVKNVVGQETISIEIRVTDEPKPPGPVELDENVHGTVTISWTASPDEKRDDRLHYMVTKRDSSKRTWNTIADRIFNNRFTACNIMPGREYQFRVYAKNDMGSSKPSESPKWLIPAKKEKFTVKVPESKACNLLCPPKFIVPLKMHTAPEGYECYMTCAIKGDPTPHVTWLRDNVSLNTNTNYLISNTCGVCSLLILRVGSKDTGEYKVAAENSLGRAESATKLTVRE

SEQ ID NO: 2251 - protein, 332 aa, Oreochromis niloticus
MSTKEKLIGHVMKEEPVGSRCKVTVVGVGMVGMATAVSILLKDLCDELALVDVMEDKLKGEAMDLQHGSLFLKTHKIVADKDYSVTANSKVVVVTAGARQQEGESRLNLVQRNVNIFKFIIPNIVKYSPNCILMVVSNPVDILTYVAWKLSGFPRHRVIGSGTNLDSARFRHIMGEKLHLHPSSCHGWIIGEHGDSSVPVWSGVNVAGVSLQGLNPKMGAEGDPENWKAVHKMVVDGAYEVIKLKGYTSWAIGMSVADLVESIMKNLHKVHPVSTLVQGMHGVKDEVFLSIPCILGNSGLTDVIHMTLKPEEEKQLVKSAETLWGVQKELTL

SEQ ID NO: 2252 - protein, 493 aa, Oreochromis niloticus
MPSKPAPIKKAAKKEPAKKEEAKAPEPAPEPAPVEAPPAEPAPAEAAPAPAEGEAAPPAEAAEAPAPEEPKPPTPPPPKEPTSAPVDLFVEDKNDTSVTIIWSQPENIGPSGLDGYTIEVCKDGTEDWKAVNEELQKASRFVIKNQTTGDRLKIRVVAVNEGGRSPPVSLPEPVLVKEVADRPKVRLPRFLKQRYVANVGDKINLTVPFTGKPKPVVTWTKNGQPLDTKRVNIRSTERDSILFIRAAEREDSGVYEICVKVEDFEDKAQITLQIVELPGPPASVKIVDTWGFNVALEWTAPKDNGNTEITGYTVQKADKKTGDWFTVLEHYHRLNATISDLIMGNTYKFRVFAENKCGMSESAAVTKDAAKILKTGIDYKPPDYKEHDFSEAPKFTTSLADRATTVGYSTKLLCSVRGFPKPKIQWMKNQMIIGDDPKFRQICVQGICSLEIRKPGNFDGGVYSCRAKNDHGEATVSCKLEVKQAVIADADKK

SEQ ID NO: 2253 - protein, 530 aa, Oreochromis niloticus
MSKPKDTGSSIIHTQQLQAAVADTFIEHMCLLDIDSEPAVARNTGIICTIGPATRSVEKAKEMIKAGMNIARMNFSHGTHEYHAETIKNVREATESFVPGSVDYRPVAIALDTKGPEIRTGLIKGSGTAEVELKKGETIKLTLDDQYKDNCDEKILWLDYKNITKVVQVGSHIYVDDGLISLKVKEVGSNYLICDIENGGMLGSKKGVNLPGAAVDLPAVSEKDIQDLQFGVEQGVDMVFASFIRKAADVHAVRKVLGEKGKDIKIISKLENHEGVRRFDEILEASDGIMVARGDLGIEIPTEKVFIAQKMMTGKCNRIGKPIVCATQMLESMTKKPRPTRAEASDVANAVLDGNDCIMLSGETAKGDYPLEAVRTQHLIAREAEAAMFHRQVFEELRRLSHLTRDPTESVAIGAVEASFKCCASAIIVLTKTGRSAHMLSRYRPRAPIIALTRCGQAARQAHLYRGIYPVLYTKPANDVWAEDVDLRVNFAMEVGKHRKFFKTGDVAIVVTGWRPGSGYTNTMRVVLVP

SEQ ID NO: 2254 - protein, 171 aa, Oreochromis niloticus
MSEKKMTSSRRHHLKSLMLQIAANWIEKEKQEIAVSKQNYVAEKCPPPALSGDQATLMETCKKLHALIDKIDEERYDLQIKVGKTDKEIDDLKIKVVDLAGVKKPALKKVRMSADAMLKALLGSKHTVNLDLRANLKQVKKEVKEEPAEAVGDWRKNIEDKADRKKMFEAS

SEQ ID NO: 2255 - protein, 234 aa, Oreochromis niloticus
MSGEHRETQEVKGMNTYSVTLSGSPPWGFRLQGGKDFNMPLTVSRVQLTPGGKAAQAGIDVGDWVVAISDANAEEMTHVEAQNKIREASGSLTLTLSRFRPSKAGGDQKVQMEAHYKFRGETTFYDDIYQQSKYRHGLRVENIPCFIPNDRSKKRLIEDTEDWQPRTGTTQSRSFRILAQLTGTDFSTVQDPDDENMKRSRYREKFLTEIQSPRYARLRDWHHDRSARALNIKS

SEQ ID NO: 2256 - protein, 542 aa, Oreochromis niloticus
MVKITTVKTKPYTDQKPGTSGLRKRVTVFQQNQHYAENFIQSIISVIEPAERQTAALVVGGDGRFFMKDAIQLIVQISAANGINHLVIGHNGIILTASHNPGGPNGDFGIKYNISSGGPAPEGITNKIFEISKGLQEYHICPDLKVDLSKIGKQTFEVDTFKPFTVEIVDSVDDYAEMLRGIFDFAALKELLSGANHINVRLDAMHGVVGPYVKKIVCEELGSPANSAVNCVPQEDFGGHHPDPNLTYAADLVKTMKGGEYDFGAAFDGDGDRNMVLGKHGFFVNPSDSVAVIAANIKSIPYFQKTGVKGLARSMPTSGALDNVAKTLQMDLYETPTGWKFFGNLMDAGKLSLCGEESFGTGSDHIREKDGLWAVLAWLSILATRKQSVEEILKDHWQKFGRNFFTRYDYEEVDSDAANKMMKDLEATMSDASFKGKKFSSGDKTYEVAIADNFAYTDPVDGSVSKNQGLRIIFSDGSRIIFRLSGTGSAGATIRLYIDSYEKDAQKIYQDPQAILAPLVDIALKLSQLHERTGRTGPTVIT

SEQ ID NO: 2257 - protein, 247 aa, Oreochromis niloticus
MTRKFFVGGNWKMNGDKKSLGELIQTMNGAKVDPNVEVVCGAPSIYLDFVRSKLDPKFGVAAQNCYKVPKGAFTGEISPAMIKDCGVNWVILGHSERRHVFGESDELIGQKTAHALENGLGVIACIGEKLDEREGGITEKVVFAQTKVIADNVKDWSKVVLAYEPVWAIGTGKTASPQQAQEVHDKLREWLKTNVSEAVANSVRIIYGGSVTGGTCKELASQKDVDGFLVGGASLKPEFIDIINAKA

SEQ ID NO: 2258 - protein, 312 aa, Oreochromis niloticus
MTDKPGMTTGGGDDAGSIMALLERVAGLMDSVQVTQQRMEERQLELESTVKTIQADVVKLTNEHANTSSTVDRLLEKTRKVSRHIKDVRVRVENQNIRVKKVEATQGDLLAKNKFRVVIYQGDQEVKSVAPGNEPEEPSSSGARARAEVEPDKFELPPESDEEYMVVEEADSSAASRIKKTGLTRIESFKATFSKENMSKTRENLGTKVNKLGERIVTAERREKIRQSGERLKQSGEKLKDTITKSVPAKLNLKKERTVAEGQEGAEGVTEGALPVPPPKGRKTSPHAARPAEDEGRAEGSEVPMYDMKQLS

SEQ ID NO: 2259 - protein, 434 aa, Oreochromis niloticus
MKWTWVLVVVLLSFGSISLGKDSLDFPEYDGKDRVHDLNAKNYKSVMKKYDIMVVYYHDHPGSSRAAQRQFEIEELALELAAQVLDEFDDEDIGVGLIDAKHDKAVAKKLGLDESDSIFVFTEDEVIEYDGELAADTLVEFIYDVLEDPVEIIDNSKELKGFKNIEEDIKLVGYFKSHKSEHFEAFADAAEEFHPHILFYATFNPKVAKALDLKLNEVDFYEPFMDEPVVVPGKPYSEEELVKFIEDHDRPTLRKLQPHNMYEIWEDDVDGEHIIAFAEESDPDGFEFLEILKQVAEDNTDNPDLSIVWIDPDDFPLLLPHWEKTFGIDLSHPQIGVVEADDADSVWLDMDDGEDLPSADELEDWLEDVLSGEIDPDDDDDDDDDDDDDDDDDDDDDDDDDDDDDDDDDDDDDDDDDDDDDDDDDDDDDDDDDY

SEQ ID NO: 2260 - protein, 194 aa, Oreochromis niloticus
LISDKLKDAKIIFVVGGPGSGKGTQCEKIVAKYGYTHLSSGDLLRAEVASGSERGKQLQAIMQKGELVPLDTVLDMIKEAMIAKADVSKGYLIDGYPREVKQGEEFEKKIGKPCLLLYVDAKADTMVKRLLKRGETSGRSDDNEETIKKRLDLYYKATEPVIAFYESRGIVRKVDSELPVDDVFVQVSKAIDVL

SEQ ID NO: 2261 - protein, 264 aa, Oreochromis niloticus
MAAAHRLVIVRHGESAWNQENRFCGWFDADLSEKGLEEAKRGAQAIKEAGMKFDVCYTSVLKRAIKTLWTIMEGTDQMWLPVIRTWRLNERHYGGLTGLNKAETAEKHGEEQVKIWRRSFDIPPPPMDKDHPYHKIISESRRYKGLKPGELPTCESLKDTIARALPFWNEVIVPEIKAGKNVIIAAHGNSLRGIVKHLEGMSDAAIMELNLPTGIPIVYELDANLKPIKPMSFLGDEETVKKAMEAVAAQGKVKNSMQVWRGKA

SEQ ID NO: 2262 - protein, 299 aa, Oreochromis niloticus
MSDAVISFMKDFLAGGIAAAISKTAVAPIERVKLLLQVQHASKQITAETQYKGIIDCVVRIPKEQGFISFWRGNLANVIRYFPTQALNFAFKDKYKKIFLGGVDQKKQFWRYFAGNLASGGAAGATSLCFVYPLDFARTRLAADIGKGPAEREFTGLGNCIAKIFKTDGLRGLYLGFNVSVQGIIIYRAAYFGCFDTAKGMLPDPKNTHIIVSWMIAQTVTAAAGLVSYPFDTVRRRMMMQSGRKGADIMYKGTIDCWKKIIKDEGPKAFFKGAWSNVIRGMGGAFVLVLYDEFKKFTY

SEQ ID NO: 2263 - protein, 467 aa, Oreochromis niloticus
MTVGNMERAELFDAGSKGRGLRAAKELNTGEVIFSEPSFAAVVFDSLATQVCHSCFRHQANLHRCAQCKFAHYCDRTCQTACWNEHKQECGAIKKLGSAPSENIRLAARVLWRMHKDTGIASDSQLISVDQLQEHVADLAAEDFKQLRADVHKFLQYWSYGTRQHSVDYISHIFGIIKCNGFTLSDQRGLQAVGVGLFPNLCLVNHDCWPNCTVILNHGNQSAVSSALHSQRRIELRALGKIPEGEELTVSYVDFLNLSADRQKKLKERFHFDCTCEHCSKHIKDDLMTAVADSKPSADKVKEVTAFSKESLEKIEKSRVERDYNEVLKLCYECLQKQENVLADTNLYKLRVLSIASEVLSYQRSFAKAANYAHRMVEGYRKLYHPNNAQLGMAIMRAGVTHWHAGQIEEGHSLICQAYRILMVTHGPNHAITKDLEGMRTQTEMELKMFKQNKAAYQTMRDAALKH

SEQ ID NO: 2264 - protein, 163 aa, Oreochromis niloticus
STSMTDAQQEARSYLSEDMLAEFKAAFDMFDTDGGGDISTKELGTVMRMLGQNPTREELDEIIEEVDEDGSGTIDFEEFLVMMVRLMKEDQAGKSEEELADCFRVFDKNGDGYIDREEFALIIRSTGEAISEEEIDELLKDGDKNNDGMLDFDEFLKMMENVQ

SEQ ID NO: 2265 - protein, 354 aa, Oreochromis niloticus
MGCTLSTEDKAAVERSKMIDRNLRDDGEKAAREVKLLLLGAGESGKSTIVKQMKIIHEAGYSEEECKQYKAVVYSNTIQSIIAIIRAMGRLKIDFGDPARADDARQLFVLAGSAEEGFMTAELAGVIKRLWKDGGVQACFSRSREYQLNDSAAYYLNDLDRISQATYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 2266 - protein, 462 aa, Oreochromis niloticus
MGKEKLHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGAKQLIVGINKMDSTEPNYSQKRYEEIVKEVSTYIKKIGYNPDTVAFVPISGWNGDNMLEPSPNMTWFKGWKINRKEGNASGTTLLEALDAIQPPTRPTDKPLRLPLQDVYKIGGIGTVPVGRVETGLLKPGMVVTFAPVNVTTEVKSVEMHHEALSEALPGDNVGFNVKNVSVKDIRRGNVAGDSKNDPPQEAANFTAQVIILNHPGQISAGYAPVLDCHTAHIACKFAELKEKIDRRSGKKLEDNPKSLKSGDAAIVDMIPGKPMCVESFSEYPPLGRFAVRDMRQTVAVGVIKGVEKKVSTTGKVTKSAQKAQRNK

SEQ ID NO: 2267 - protein, 805 aa, Oreochromis niloticus
SLHWNPPLNDGGATVSHYIIEKRETSRVTWTGVEAHVEALSYKVTKLVPGKEYVFRIAAVNKYGVGEFLESDPLIAQNPFTPPSAPSTPIATAVTGDSVTLTWERPETDGGSEIDGFIVEKLDKEGVRWTKCNKRRLNDLRFRCTGLTEGHYYQFRILAENAAGVGAPSDPSEYIKVCEATYPPGPPTNPKMTDYSSSTVSLTWSKPIYDGGATISGYVVEMKEATDDEWITCTQSAGVEDTNYTVKRLRENAEYNFRIRAINAAGVGDHVDLPGSVVAAEKVEAPEIELDAALRKIVSVRVCSTLHLFVTIRGRPEPEVKWSKEGDTLSERAQIEVTSSYTVLLIENVNRNDTGKYVLTASNCCGSKSAFINVKVLDSPSAPTNLEVKDVKRDSVSISWEPPLIDGGAKISHYVVEKREETRKAFTSVFSNCMRNSYKIDNLQEGCFYYFRVLAVNEFGTGLPAETTEAIKVSEVPLPPGKITLNDVTCSSARLSWEKPAHDGGSKITCYIVEMQAKGDDTWTKCSESKALDAIIDGLTKGKEYFFRVCAVNEKGKSEPKCLLAPVIVKDTSTEPMISLLSNTFSVKAGNDLKIDVPFKGVPPPTATWKKDGNALKETSRVNVSTSDTSSQIIIKDATRIDVGVYEVTLTNSVGTTSAQIFVNVFERPGPPADLSVDDVSADFVSLSWQPPHYTGGCQITNYVVEKRDTGSTLWQNVSATVARTSIKISRLTQGTEYQFRVATENRYGKSQFTESEPVVAQYPFKPPGSPPNLHVVQASKSVMVIAWSKPESDGGSPIIGYHIE

SEQ ID NO: 2268 - protein, 814 aa, Oreochromis niloticus
MAEHHPVSENKHKSSLNSGVAYSGNGRSSTAVAERGNSAGAGGGGGLSGGLSQPAGWQSLLSFTILFLAWLAGFSSRLFAVIRFESIIHEFDPWFNYRSTHHLTTNGFYEFLNWFDERAWYPLGRIVGGTVYPGLMVTAGLIHYVLNLLHITVHIRDVCVFLAPVFSGLTSISTFLLTRELWNQGAGLLAACFIAIVPGYISRSVAGSFDNEGIAIFALQFTYYLWVKSVKTGSVFWTIGCCLSYFYMVSAWGGYVFIINLIPLHVFVLLVMQRFSRRVYIAYSTFYIIGLVLSMQIPFVGFQPIRTSEHMAAAGVFVLLQVYAFLQYLKDRLTRQEFQTLFFLGVSLAAGVVFLSVIYLTYTGYIAPWSGRFYSLWDTGYAKIHIPIIASVSEHQPTTWVSFFFDLHILVCTFPAGLWFCIKNINDERVFVALYAISAVYFAGVMVRLMLTLTPVVCMLSAIAFSSVFEHYLGDEMKRQSPPAEDSSDEDDRKNAGNLYDKAGKVRKHVSEQEKAEEGLGPNIKSIVTMLMLMLLMMFAVHCTWVTSNAYSSPSVVLASYNHDGSRNILDDFREAYYWLRQNTDEHARVMSWWDYGYQIAGMANRTTLVDNNTWNNSHIALVGKAMSSNETAAYEIMRSLDVDYVLIIFGGVIGYSGDDINKFLWMVRIAEGEHPRDIRESDYFTPQGEFRVDKAGSPTLLNCLMYKMSYYRFGEMQLDFRTPPGFDRTRNAEIGNKDIKLKHLEEAFTSEHWLVRIYKVKKLENRDRVEHKLRSTDANRQKYSSKKTAKRKRGYVKNKLSLKKGKKLTKKSL

SEQ ID NO: 2269 - protein, 1518 aa, Oreochromis niloticus
HLKQIRVLMLNDKQNLERTLFRLEQGFELQFRLGPSLQGKKVMVHTNYPLEGQLFDRNNFRVLPWTYPTGKEEDSDKFCSLDLKLAGSYQYYFGRDSERIGGGYIVVDPVLRVGADDHILPLDCITIQTYLSKCLGHLDDWPDRLRVAKESGYNMIHFTPLQTLGESRSCYSLADQLSVNPEFSPAGRSYDWTDVGALVEKLKTEWDMLCITDVVYNHTAANSGWIREHPECGYNLVNSPHLRPAWVLDRALWHLTTRVAEGRYKAKGLPADITTESHLNAVRSVVWQDVFPQIKLWEFYQVKVDSAVEEFRTLLQNGTKPDHSKTGGKTGLRIIQDPQYRRYGNTVDMDSALETFVPHSFSPQHIEECCSWLNQKLTDLNAEQYHIVHQHQEQAVNCLIGNIVYERLAEHGPKLGPVTRKNPMVTRYFTFPYQDMTLDQEMQLLDQPDKLCHFLAHNGWVMGDDPLRNFAEPGSNVYIRRELICWGDSVKLRYGNTPDDCPYLWYHMKKYTQITAKYFHGVRLDNCHSTPLHVAEFMLDVARTVRPDLYVVAELFTGSEELDNIFVTKLGITSLIREAMSAGDSHEEGRLVYRYGGEPVGAFVQPSLRPLTPSIAHAMFLDVTHDNECPIQLRSAFDALPSSAIVAMACCATGSTRGYDELVPHQISVVKEERFYPKWNPSAVPSSSGEVSSCTGIIAGKRAVNKLHQVCPTPPVQVYVDQVDADIVAVTRHCPSTHQSVVTVSRTAFWDPKTHQYSTSVPPMFIPGKIEEVVLEARMVERSAGKYKKDENYINGMPEYTVEIKEHISLDESTVMKKAGVTSKGRSEFVHEITFQKLTPGSIIAFRVSLDPKAQKMVGLLRYYLSQFSPKYRRGSVADENPPDALKKPLAQLMSKLTLADMNVLLFRCDTEEKEEGGGCYSIPGWETLKYAGLQGLMSVFADVRPNNDLGHPLCANLREGDWLIDFVANRLMHREGPLAEVGHWLVAMFNFLKHIPRYLIPCYFDAILVSTYTTALDATYKLMSSFVQNGSTFVRHLALGSVQMCSVGRFPALPPVSAQLDDVPYRISPITGQKEQYCVSLAAGLPHFSAGIFRCWGRDTFIALRGLLLLTGRHVEARNIILAFAGTLRHGLIPNLLGEGRCARYNCRDAVWWWLQCIQDYTTQVPRGHEILSCPVTRMYPTDDCEPCKPGGVQEQPLYDVIHEALRRHLEGISFRERNAGPKIDMNMRDEGFSVVARVDPATGFVSGGNRFNCGTWMDKMGESERARNKGMPATPRDGAAVEIVGLSKSAVRWVVELHAKGLFPYDGVKLHRDGKEVFISYSQWNKQLNQSFEAGFWVSGDPDDPNEKHPELVHKKGIYKDSYGSSSPWCDYQLRPNFTVAMVVVSQPQPTPRFPLGMKTLDPDDLVYCGVYDNALDNDNYNVARGFNYHQGPEWLWPVGYFLRAKLYFAKMLGEDTYAKTVTLVKNVLSQHYTHLERSPWKGLPELTNENGQHCPFSCETQAWSLATVLEVLYDL

SEQ ID NO: 2270 - protein, 2705 aa, Oreochromis niloticus
MMSTNYGDDQLPPQYYQATDFGEEEDDEMPATEKDLAEDAPWKKIQQNTFTRWCNEHLKCVNKTVTDLQKDFSDGLKLISLLEVLSQKKMYRKHHNRPNFRQMKLENVSVALEFLDREHIKLVSIDSKAIVDGNLKLILGLIWTLILHYSISMPMWDDEDDEEAKKLTPKQRLLGWIQNKVPQLPINNFNRDWRDGKALGALVDNCAPGLCPDWADWDPNKPVQNAREAMQQADDWLGVPQVIAPEEIVDPDVDEHSVMTYLSQFPKAKLKPGAPLKPRQLFPNKAKAYGPGIEPHGNKVLQPAVFTVETLEAGSGEVLVYVEDPEGHKEEAKVKPNNDKNRTYTVTYVPKVEGVHKVKVLFAGQDIDKSPYTVNVAKALGDPSKVQARGPGLEPTGNVANKPTYFDIYTAGAGNGDVSVVIVDPQGKKDTVELILENKGDSVFRCTYRPVLEGPHKIHVLFAGQEIPKSPFTVNIAEAINPNACRATGRGLQPTGVRVKEVADFKVFTKGAGSGALSVSVKGPTGAEEQVKVRDVGNGVYECEYYPLKPGKYTVTITWGGQPIPRSPFEVQVGAEAGFQKVRAWGPGLKTGMVGKSADFVVEAIGTEVGTLGFSIEGPSQAKIECDDKGDGSCDVRYWPTEPGDYAVHVICDDEDIKDSPFMAHILPAANDVFPEKVKAYGPGLKPTGVIVNKPAEFTVDARMAGKGQLKIYAQDAEGSTIDIKITDRGDGTFHCVYTPVKPIKHTIIITWGEVNVPSSPFRVLVGEGSHPDRVKVYGPGVEKTGLKANEPTYFTVDCSEAGQGDISIGIKCAPGVVGPAEADIDFDIIKNDNDTFTVKYTPPGPGRYTIMVLFADQEIPVSPFKVKVDPSHDAGKVRAEGPGLNKTGVEVGTPTHFNIYTKGAGKAKPEVHFAASGPGEAIRDFEIIDNHDYSYTVKYTALQQGNMTISVTHGGDPIPKSPFHITVSPAMDIGKVKVEGLDTKVEVGKDQEFTVNTKDAGGQGNVGVKMTSPSGRPIPCKLESDKAKGAHSVKYIPPEEGQYKVDVSYDGNPVMGSPFGVEAVLPADPSKVRAFGPGLKGGVVGKPAPFTIDTKGAGAGGLGLTVEGPCEAKIECQDNGDGTCSVAYLPTEPGEYAINILFAEQHIPGSPFKAAVRPAFDPSKVTASGPGLERAKAGEPATFTVDCTRAGDGELTIEIVSETGVKAEVHIQKTAEGTFSVTYIPPFHGTHTITIKYGGHVIPHFPKVLQVEPSVDTTGVHVYGPGVEPRGVLREVTTHFIVDARALNKVGGNHVKVHIINPSGTNTDTYITDKGDGTYRVEYTAFEDGMHLIEVLYDDVPVPKSPFRVSVVEGCDPTRVRAFGPGLEGGITNKPNCFTVETRGAGTGGLGLTIEGASEAKISCKDNKDGSCSVEYVPFTPGDYDVNINYGGHPIPGSPFRVPVKDPVDPSKVKCSGPGLGAGVRAHVPQTFTVDCTKAGQAPLDVKLYGPTGTVEPVGVKNNGDGTHTVHYTPAQDGPYTVAVKYADQEVPHSPFKVMSQPGHDASKVRASGPGLDTKGVPASLPVEFTIDARDAGEGLLTVQILDPEGKPKNATIQDNRDGTYTVSYVPDSTGPYTITIKYGGDEIPYSPYRIQSLPTGDASKCRVTVSIGGHGVSSLQKLQTSEDTVITVDAKAAGKGKVTCKVLTPQGMEVDMDVVENHDGTFDIYYTAPEPGKYVITIRFGGQNIPKSPFHVMATNEPVVPRDTVDPLFRPVNFLVPFTPQQGEITGEVRMPSGKTARPHITDNKDGTITIKYQPTEKGLHEMDIKYDGNHIPGSPLQFFVDAVNSGVVTAYGPGLSYGMVNKAATFTVVTKNAGEGGLSLAVEGPSKAEITCKDNKDGTCTVSYLPTAPGDYNIIVKFDNKHIPGSPFTAKITGDDSITRTSQLNVGTAADVSLKIAETDLSSLTASIRAPSGNEEPCLLKRLPNRHLGISFTPKEVGEHEVSVRKNGMHVANSPFKIMVGQSEIGEASRVKAFGKGLVEAHTFEMAEFFVDTRNAGYGGLALSIEGPSKVDINCEDVEDGTCRVTYCPTEPGSYTVNIKFAEKHIPGSPFTVKVTGEGRIKESITRKRQASSIASVGSTCGLNLKIPGNWFQMVSAQERLTRTFTRSSHTYTRTERTEISKIRGGETKREVRVEESTQVGGRGSPFRDVFGDFLGRESLSSFAGITARPEVESGSQAMTAQVTSPSGKTVDADIVDGGSSTYSVRFIPQEIGPHTVNVKYRGQHVPGSPFQFTVGPMGEGGAHKVRAGGPGLERGVAGAPSEFSIWTREAGAGGLSIAVEGPSKAEISFEDRKDGSCGVSYIVKEPGDYEVSIKFNNEHIPDSPFIVPIATLSDEARRLTVTSLQEKDLKVNQEASFMVQRNGARGVVDAKVHTPSGSSEECYVTELDSDKSAIRFIPRENGVHSIDVKFNGCHIPGSPFKVRVGDPGLIGDPGMVTAHGPGLQGGTTGVPSEFVVKTCNAGSGTLSVNIDGPSKVKMDCRECPEGYKITYTPMAPGNYLITIKYGGPQHIVGSPFKAKITGTRLSGGHSLHETSSVLVETVTKTSKVGGAYSSSSSTTSSKMTSDASKVVCRGTGLSKALVGQKNNFTVDCSKAGTNMLMVGVHGPHAPCEEVYVKHMGNKLYNVTYTVKDKGSYTVIVKWGDDNVPGSPYKVAVP

SEQ ID NO: 2271 - protein, 7000 aa, Oreochromis niloticus
MAQYAPQAYALSDEQEYLQAYEDVLEKYKADERDRVQKKTFTKWINQHLVKVRKHINDLYEDLRDGHNLISLLEVLSGDTLPRERGRMRFHRLQNVQIALDYLKRRQVKLVNIRNDDITDGNPKLTLGLIWTIILHFQISEIHVTGESEDMTAKERLLLWSKQMTEGYVGVRCENFTTSWRDGRLFNALIHKYRPDLVDMSRVSTQTNRSNLEDAFCVAEQLGVARLLDPEDVDVQSPDEKSVITYVSTLYDAFPKVPDGVEGVSPNDVDIKWVEYQNMIKYLSQWIKHNVAIMSSRSFPNNPVELKALYTQYLQFKEHEIPQKENEKTKIKNLYKMLEMWIEFGRLQLPPGHHPNDVEKEWGKLIVAMLEREKSLRPEVERLEMLQQIANRVQRDCVNGEDKLALARTALQSDAKRLESGIQFLNEAEIAGYLLECENILRQQVVDIQILLDGKFPFADQLVQRVSKLRDDLLALRAECSSVYSKGRTLTTEQTKMMISGITQSLNSGFSQSINTNLTPALTPALTPGGVGTPGSTFTSSLTPCLTPSLTPALTPSLQPASIQSYMGSGGGMGPSSLRHLKNMQIRKPLLKSSLADPSLTEEEVNMKFVQDLLNWVEEMQMELERSDWGSDMPSVKMNLDNHKNVHRVIEEFQMSLKEAKLSEIQMTMPLKLSYSDKLNKLEKQYEQLLSSSRERQSHLESLHDFVSQATQELIWLNEKEEEEVAFDWSDRNINISKKRDYHTDLMRELDEKEEAIKSVQDKAERLMLKNHPARLTIEAYKAAMQTQWSWILQLCSCVEQHLKENAIYFEFFSDAKESMDYLKNLQDSIQRKYSCDRTSTLHRLEDLIQESMDEKEQLLQYRSTVAGLVGRAKNIVQLKPRNPENSLRSSIPVKAICDYRQIEITIYKEDECVLANNSHRAKWKVINPAGNEAMVPSVCFTVPPPNKEAVDMASRTEQLYQNVLALWHHSHVNMKSVVSWHYLMADIQAIRNWNVASIKTMLPGEHQQVLSNLQSHFDEFLEDSEESEVFTVADCAQLERDVAACKEYYQELLRSAEREEHEESVYNHYISEIRNFRMHLEAHEEHLIRQIRSPLERDDLEQSLQRITEHERKTAELNKLKEDLDAMKDKCELFLRQAAGSPSVATLSSELTVLIQSMSQVYSMSSIYMDKLKTVSLVVKHSQSAEALVKAYESKLYEEDAMNPDVKSIENVISTLKHWRTEIDERQEVFHDMEDELQKARLISDRMFKAHNERDFDLDWHKEKADQLSERWQNIHSQIDSRLRDLDGISKSLKHYRDSYSSLDEWVRDMEAAQLKAQEHKPEDSKALAELLNKQKILVAEIEQKQSSIDECQKYSEQYSSAVKDYELQLMTFRAMVDSQHKSPLKKRRMQSCSDAIQQEFMDLRTRYTALVTLMTQYVKFASETLKRTEDEERSVDEEKREHGDKVNKLLQWMSNVKQTVSNGGDALKDSNANTDASNKPQVSVEEMVTKKEQIAEALRSTQTMLNKHSDKMTEEERKKAQEQLQSLTQAYNELSQQCSDQTPSADELKPVKPEYAVNMLIAPSCGLIFHLFQIGTGMSGLIDQRGLVNLQGALLTSNLSEPQLHLGCDDAIEENRIYTSTLNHLPVLNDSSKCIQSSHVSSVSLSDIAAAREGSMCEDMIIKIIEASQVSDEVKMCYTGDTMTLEKAFQCGLIPASVYVNLLQRKKSHQDMITPSTAESLSFLEPEEEGEACEVNKLIFKGLSRKRSETSERNISSVTSGGFSNQEIMVRLLGAQGDLEGQNETEVSDGNFQNAGGGLKVDAAIQCDLMSSSSTLIVLGNQQQFMGLALPHSGEIQTVSTSHESDCQSTSSEFTCRLFTNRGKIAAFYIPENSEVIDITTAIQNGWIDSHTAEVLKSIEIPDVLPDVDHLSEKFSSWLTYKKLAVDGWPHDGSEVNLPSPTEAKQLFISYLMMNSYIDPKSEQRVLILDDQLNKMAQAFLEDRLFYLNDDEGLTDLTLDAENPFEDADSEMSLHINDESEDLIKNTEDVFDRRDFVSQTGGRITFDENTQHTFEPHNFVSSGNGRITFDEKSNKNDKASKHDHARDLLVSSDIDIDTRGVEVENVFENGTESEKEAGDYAREDLDIPGSLHVSVPHTFCSGESRNISSPSVMIDSESSFRSCHQVPPHYKAKCFETTTSVHIEQPQFLSSEDSVEGGNERKSAIELLKTQMEEEGILDVTSGKCYNLQEALNKGLVDDKMVLELHDSHRSIGDSLLLELVKDSDSQGNFYPEENRVYSLSEDQDLGLIHAAEIHKAENTQQVISRNAAVTVLDLAKEEANNKEGESENRNPELACKAVGSVETMTNKVHLSLPSESGNMPQMISPSLWNQVTAERTNHIEKLPLGAEDSESHTLMDSELTGKISSINTDSKSQTQSATFAYHSSKSDSTPSDEDIFSDGYDTSVRNQTFIQSETGTSVSFCSALSLEARVEDESGVRSTLGSEPAPSVDYTSLGDLVEGAVISVSRGFTDGGAGDSERPSLEKQNDDILTIDGEQISIAFCQRDQSLIAAACERPPQQQSSSSELPAIYSSITATNTILHSNNDIEDSALTPKDLFGLAPGGAGDPERLFQERGNNDILTIDAVSLCQGAQSLSSPVCEGPHQQSSSSELPAVYSSTTATNTIDHSYSDLVLTPKDLLGFTCGLTSDAERLSQNSSITATNTINHSNNDIEDSALTHKDLLGSPPGGAGDPERLSQERENNDILTVDAEQIPVSLSQRDRSLSAAVCEKPPQQQSSSSELPAVYSSITATNTISHSNNETEESVLTPKDLLGSSHLDQRDRNLSAAVCEKPPQQQSSSSEIYSVNRDITTSTINQRSTHGGGGDAERLSPEKQNDDIFNIDAEQISASLCQSGAPVCKRPAQELSSSSEIPAVLTATDTVNHSSNDVEDLVMTPKDLLESALGVTDINFGQPGSRIEVCVSVDTHTVTDFLSESSIIPVVSSSGPSVFSNPGKTYADDQGEDITHNDKSSGLERAQAQDSQHALAIDKSSFHESSTSQGLTQSSHPDHLMNLLKQNSLSLDSEDTRKAKLICPEERGGQETEQSDAPNIQLQLLQVFKTVSTSQDLSVLKEVMDTLSSALGCESQQEQWHTLESIKEESSEGEDEESELFSIHDYLECVGRLQDHSDALEDARKDLTIPIPTDNSMEELQNQIEECQSLQSQLSSLADVLTVDMEKAKQLINSADEDVPQQIHHDLASIYLELEPNFTAVSQMCAERSNSLIQAMETGKVHLESTYQQHLSDLNTLAGLIQTNSKMLGVDLNTCDLDTLKHLSQQNKDMEDHLQKEARLKLEDVTFDIQCFISEHTQFLSPAKSSYLLKFLSTTQRAFRDQIERLVTQKSALDVLLDARERESMAESLLEKQKEFTDKLSDMCDNLTLTENRLIGHKQQAENAESITDLQQYQQEDQALQKDVLTNASALNDVISSTNKFLQENRSKMTPDQIAAIESKLEEAKSKAKLINQRAEDSRKDLEKAVTTAIQQESEKAAAVEQLEESKSKIEGLLDWISNVGNKNKSSLDQTDHVSQENGNLPEEPSAKGLITEDDDANGNALQTTDKDFGRETNGENNESPNLDKQYQRLKAHHQEILSQQQDLIMATQSAQAMLDKQANVLSPQEKEALQKNIQELKERYETSLTQAEQQMKQVQCVQEELKKFQDDCEEFENWLNQAEEEILELGAPASSLNILSDNLQRQKSFSEDVISHKGDLRFITISGQKVLDVAKAFGSADPAAKNPLLHVDTSGTCSAVKDKLDSAASRYKTLHSQCNLLGNNLKDVVDKYKKYDDSSTGLLKWLNSSEEEARKQQSEAIAADPQTLQKQLEDTKVLQGQMMGHQTAIDSLRKTAESLITSEGDLLSNPDEIQETVDDIVERYDNLSKSVSDRNEKLQITLTRSMSVQDGLDEMMGWMEGVEASVEEKREITLDSASLGGILSKEAALEQDIASRQSSISAMKAKVKKFVETADPSAAALLQSKMDSLSQRFSDACDQHRQKIATVEKLKEKVEQFENVAEKVQQFVVKRSQDLHETDGPGKTFNELSQLMQNTKAEMAEYAGDLEKLQTLSKELSEISPDGNKAQIQSKLDNLSNVFSTFKDTIKEKEEELSSCQDQLGEFRSAASALTKWLEEANDKVPADQPSSSEKTLESNLQIVTGLLDEWTSKGPAVQDLNTKGSTLCNLITFLTSPAKTKTPNKSGKPLTNGDGPASHTYLTNKELMVIQQNMSSINEGYTDLGETLKNRSAQLSSLLQEVKEAQKETDDMMLWLKDMKKTAQSWNSAATEKDSVKTQLEQQKAFEDNMKQKQEALQKLREKLLDLIKTHPNSPEAAKWKQMLAEIDAAWADISGSVEERKQHLEQSNKNLDIFQTTEQQLGQWLSEKELMMSVLGPLSIDPNMLKMQKQQVQILQNEFKSRKPQYEQLEEAASAILSSSGDQDPSSGKLVKEQLAAVTQKWAGLTGQLDQRDSHIDQAVVKTGKFQELLRSLSNTATQLESQLTNHQGLSTQPDAVKKQLEDAQNISAQLREEKKKLKEAEAINEELTAMVTEDYLKADLARQLESVCKPFKQLEEKAAKRIEQLNSTFASSQQFHQTSKDLQSWLGEKLQDQSKPKPISAKVEVLQQTVEEHSKLQKALSEHEKAFNTIIGEGEMLLHNIDGAEKLALQGQLTTLSSNWEEVKKSSAEQADKLQTALMRSLKYQEHAEKLNSWIQECEANEGRVKLTVDPAAVETSISQLKALQKDVDKHRGLVEQLNAAADSLLEVANTDTDAIKEEKASTGKRVDNIVESLQSKRESLEKISHTVKEFNDACKEAKTQLEGAKKQVDAYETQGVQAHSNKSLTNMKAQHKSLEAVQNQVEHMKALAKDLVVDVPDAEGVTDLLLQADSIEKDYGNLNKKLEETCQALEGKLQGIGQFQNNIREMFAQFTELDDELDSMSPVDLNLDTLKEQQDSIQSFVAKLRELMANTANAGDSCKKMLESEPSPDLLGLKRDLDALSKQCGKLLDRAKGREVQVQSTLTKLEELYGKVNQMEDKLCRAVDKEASQEPVGMETEVLNQQLEAFKAFQKEDIDPLQNQLQDINSLGQGLIQNAAKGTSTKKLEDDLEGVNSKWNTLNKKIAERSAQLHEALLHCGQFQDALESLLSWLTDTEELVANQKPPSAEFKVVKAQIQEQKLLQRLLDDRKPTVELIKKEGGKVAELAESVDKEKVAKEIECLGQRWDTLLKKAENRHKQLESILVVTQQFHETLEPLSEWLSATEKHLTNSEPIGTETSKLEDQISQHKALQSDIGLRKKNVDQAISNGVELLKQTTGDEVIVIQGKLDGIKTKYAEINSMSDSVLKTLEQVLSLSSKLQHTHTDLSSWLEKAEAEIKSFAHQEPVGEQLIHSQSRQKAMLKEIKDQKPVLDQLNELSSSLLDLVPWHTRESLDKLVSEDNERYRAAYDTLTQKVDQINADILKSQQFEQAADNELSWLTDAERKLLSMGEIRLEQDQTTAQLQAQKIFSMDIMRHKDAVDEIVKTGKAIMTSKNPEEKEILKAKTQTLLEKYGVVSQLNSERCLQLERAQSLATQFWETYEELGPWLQETLSTFSQLPPPAIEYDTLRQQQEDLRQMRELIAEHKPHIDKMNKTGPQLLELSPVEGEPIREKYTATDQLYTKLKADVKQRAATLDEAISKSTQFHDKIDPMLESLERIAERLHQPPSISVEVDKIKEQITENKTVSVDLEKLQPSYETLKQRGEEMIARSEGTDKDLSAKVQAVQDKLDRMVFLWNDIQALVEERETKLLDVMDLADKFWCDHTALIVTIKDSHDLLRELEEPGVDPSVVKQQQEFVEGFKEEIDGLQEELDGVRNQGAELMTACGEPDKPVIKKSLDEVNTAWENLNKTWKERGERLEEAMQAAVQFQDGLQGMFDWVDILESKLDSMSPVGTDLETVKQQIVELKEFKGEAYQLQIEMERLNHQAGLLLKKVTEEADRSAIQEPMSELKMLWDNLDEKIISRQHKLEGGLLALGQFQHALDELLAWMSHTEELLNEQKNAGGDPKAIEIELAKHNVLQIDVLAHKSTVETVNKAGNDLVQSSAGEEASSLQSKLENLNQRWKAILEKMGQRKQQLESSLLQAQGFHGEIEDMQQWLKDTERQLLASKAVGGLPDTAREQLIAHLELCSAFEAKEELYRELQNKGHQLLTMMPESPDSNTEQDLANLKEKWEAVQAKVAERKVKLEEALTVATDFHNSLQDFINWLTQAEQTLNTVSPASLILETIMFQIDEHKMFVTEVNSHREHIIELDKTGTHLKYFSQKQDVVLIKNLLLSVQGRWEKLVQRSVERGRLLDDARKRAKQFHENFNKLMEWLDESEKTLDSEVEIANDPDKIKTQLAQHKEFQKALGSKHSVYDTTTRTGRALKDKTSLQDDRQKLDDMLSELRDKWDTVCGKSVERQNKLEEALLFSGQFTDALQALIDWLYRVEPQLAEDQPVHGDIDLVLNLIDNHKVFQKELGKRTVSVQALKRSARELIENTHDDSSWVKVQMQELSTRWETVCNLSVSKQARLEQALGQAEEFHSAVHILLEWLAEAEQSLRFHGSLPDDEEALRALIEQHKVFMKKLEEKRVALNKAASMGEAILSICHPDSITTIKHWNTIIKARFEEVQAWARQHQQRLATALTELLATQELLENLLTWLQWAETNLNDKDKEPLPQEIEEVKNLIAEHQAFMEEMTRKQPDVDKITKTHKRKAAAEPQIQSQIPVLDKGRAGRKRSPTQAMYASSTQAPIETKNPRVNLLVTKWQHVWLLALDRRRKLNDALDRLEELKEFANFDFDVWRKRYMRWMNHKKSRVMDFFRRIDKDQDGKVTRQEFIEGILSSKFPTSRLEMSAVADIFDRDGDGYIDYYEFVAALHPNKDAYKPLTDADKIEDEVTRQVAKCKCPKRFQVEQIGANKYRFYLGNQFGDSQQLRLVRILRSTVMVRVGGG

SEQ ID NO: 2272 - protein, 375 aa, Ovis aries; identical to SEQ ID NO: 763

SEQ ID NO: 2273 - protein, 842 aa, Ovis aries
MSRPLTDQEKRKQISVRGLAGVENVTELKKNFNRHLHFTLVKDRNVATPRDYYFALAYTVRDHLVGRWIRTQQHYYEKDPKRIYYLSLEFYIGRTLQNTMVNLALENACDEATYQLGLDMEELEEIEEDAGLGNGGLGRLAACFLDSMATLGLAAYGYGIRYEFGIFNQKISGGWQMEEADDWLRYGNPWEKARPEFTLPVHFYGRVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCLDPVRTNFDAFPDKVAIQLNDTHPSLAIPELMRILVDQERLEWEKAWEVTVKTCAYTNHTVLPEALERWPVHLIETLLPRHLQIIYEINQRFLNRVAAAFPGDVDRLRRMSLVEEGAVKRINMAHLCIAGSHAVNGVARIHSEILKKTIFKDFYELEPHKFQNKTNGITPRRWLVMCNPGLAEVIAERIGEEYIADLDQLRKLLSYVDDESFIRDVAKVKQENKLKFSAYLEKEYKVHINPNSLFDIQVKRIHEYKRQLLNCLHVITLYNRIKKEPNKFFVPRTVMIGGKAAPGYHMAKMIIRLITAIGDVVNHDPVVGDRLRVIFLENYRVSLAEKVIPAADLSEQISTAGTEASGTGNMKFMLNGALTIGTMDGANVEMAEEAGEENFFIFGMRVEDVERLDQKGYNAQEYYDRIPELRHIIDQLSSGFFSPKQPDLFKDIVNMLMHHDRFKVFADYEEYVKCQERVSALYKNPREWTRMVIRNIATSGKFSSDRTIAQYAREIWGVEPTRQRMPAPDEKI

SEQ ID NO: 2274 - protein, 607 aa, Ovis aries
MKWVTFISLLLLFSSAYSRGVFRRDTHKSEIAHRFNDLGEENFQGLVLIAFSQYLQQCPFDEHVKLVKELTEFAKTCVADESHAGCDKSLHTLFGDELCKVATLRETYGDMADCCEKQEPERNECFLNHKDDSPDLPKLKPEPDTLCAEFKADEKKFWGKYLYEVARRHPYFYAPELLYYANKYNGVFQECCQAEDKGACLLPKIDAMREKVLASSARQRLRCASIQKFGERALKAWSVARLSQKFPKADFTDVTKIVTDLTKVHKECCHGDLLECADDRADLAKYICDHQDALSSKLKECCDKPVLEKSHCIAEVDKDAVPENLPPLTADFAEDKEVCKNYQEAKDVFLGSFLYEYSRRHPEYAVSVLLRLAKEYEATLEDCCAKEDPHACYATVFDKLKHLVDEPQNLIKKNCELFEKHGEYGFQNALIVRYTRKAPQVSTPTLVEISRSLGKVGTKCCAKPESERMPCTEDYLSLILNRLCVLHEKTPVSEKVTKCCTESLVNRRPCFSDLTLDETYVPKPFDEKFFTFHADICTLPDTEKQIKKQTALVELLKHKPKATDEQLKTVMENFVAFVDKCCAADDKEGCFVLEGPKLVASTQAALA

SEQ ID NO: 2275 - protein, 298 aa, Ovis aries
  MOD_RES (253)..(253): Any amino acid
MSDQALSFLKDFLAGGVAAAISKTAVAPIERVKLLLQVQHASKQISAEKQYKGIIDCVVRIPKEQGFLSFWRGNLANVIRYFPTQALNFAFKDKYKQIFLGGVDRHKQFWRYFAGNLASGGAAGATSLCFVYPLDFARTRLAADVGKGAAQREFTGLGNCITKIFKSDGLRGLYQGFNVSVQGIIIYRAAYFGVYDTAKGMLPDPKNVHIIVSWMIAQTVTAVAGLVSYPFDTVRRRMMMQSGRKGADIMYTXTVDCWRKIAKDEGPKAFFKGAWSNVLRGTGGAFVLVLYDEIKKFV

SEQ ID NO: 2276 - protein, 333 aa, Ovis aries
MVKVGVNGFGRIGRLVTRAAFNTGKVDIVAINDPFIDLHYMVYMFQYDSTHGKFHGTVKAENGKLVINGKAITIFQERDPANIKWGDAGAEYVVESTGVFTTMEKAGAHLKGGAKRVIISAPSADAPMFVMGVNHEKYNNTLKIVSNASCTTNCLAPLAKVIHDHFGIVEGLMTTVHAITATQKTVDGPSGKLWRDGRGAAQNIIPASTGAAKAVGKVIPELNGKLTGMAFRVPTPNVSVVDLTCRLEKPAKYDEIKKVVKQASEGPLKGILGYTEDQVVSCDFNSDTHSSTFDAGAGIALNDHFVKLISWYDNEFGYSNRVVDLMVHMASKE

SEQ ID NO: 2277 - protein, 296 aa, Ovis aries
MASHRHSGPSSYKVGTMAEKFNCHYCRDNLQGKKYVQKDGHHCCLKCFDKFCANTCVECRKPIGADSKEVHYKNRYWHDTCFRCSKCLQPLASETFVAKDNKILCNKCTTREDNPKCKGCLKPIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 2278 - protein, 361 aa, Ovis aries
MYSSVVHLARANPFNAPHLQLVHDGLAGPRSDPAGPPGPPRRSRNLAAAAVEEYSCEYGSAKFYALCGFGGVLSCGLTHTAVVPLDLVKCRMQVDPQKYKGIFNGFSVTLKEDGFRGLAKGWAPTFIGYSMQGLCKFGFYEVFKVLYSNMLGEENAYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASQVLKRLGFRGVWKGLFARIIMIGTLTALQWFIYDSVKVYFRLPRPPPPEMPESLKKKLGYTQ

SEQ ID NO: 2279 - protein, 170 aa, Ovis aries
MAPKKAKRRAAAEGGSSNVFSMFDQTQIQEFKEAFTVIDQNRDGIIDKEDLRDTFAAMGRLNVKNEELDAMMKEASGPINFTVFLTMFGEKLKGADPEDVITGAFKVLDPEGKGTIKKQFLEELLTTQCDRFSQEEIRNMWAAFPPDVGGNVYYKNICYVITHGDAKDQE

SEQ ID NO: 2280 - protein, 139 aa, Ovis aries
EENRRFYRQLLLTADDRVNPCIGGVILFHETLYQKADDGRPFPQVIKAKGGVVGIKVDKGVVPLAGTNGETTTQGLDGLSERCAQYKKDGADFAKWRCVLKIGEHTPSSLAIMENANVLARYASICQQNGIVPIVEPEI

SEQ ID NO: 2281 - protein, 102 aa, Ovis aries
MVDAEMAAFGEAAPYLRKSEKERLEAQTRPFDLKKDVFVPDDKEEFVKATILSREGGKVTAETEHGKTVTVKEDQVLQQNPPKFDKIEDMAMLTFLHEPAVL

SEQ ID NO: 2282 - protein, 284 aa, Ovis aries; identical to SEQ ID NO: 905

SEQ ID NO: 2283 - protein, 121 aa, Ovis aries
ATLKDQLIQNLLKEEHVPQNKITVVGVGAVGMACAISILMKDLADEIALVDVMEDKLKGEMMDLQHGSLFLRTPKIVSGKDYNVTANSRLVIITAGARQQEGESRLNLVQRNVNIFKFIIP

SEQ ID NO: 2284 - protein, 103 aa, Ovis aries
MSSDQEMAIFGEAAPYLRKSEKERIEAQNKPFDAKTSVFVADPKESFVKATVQSREGGKVTAKTEAGATVTVKEDQVFPMNPPKFDKIEDMAMMTHLHEPGVL

SEQ ID NO: 2285 - protein, 103 aa, Ovis aries
MSSDQEMAVFGEAAPYLRKSEKERIEAQNKPFDAKTSVFVAEPKESFVKGTIQSREGGKVTVKTEGGATLTVKEDQVFPMNPPKFDKIEDMAMMTHLHEPAVL

SEQ ID NO: 2286 - protein, 110 aa, Ovis aries
HAGNKLAMQEFMILPVGASSFREAMRIGAEVYHHLKGVIKAKYGKDATNVGDEGGFAPNILENNEALELLKTAIQAAGYPDKVVIGMDVAASEFYRNGKYDLDFKSPDDP

SEQ ID NO: 2287 - protein, 142 aa, Ovis aries
MVLSAADKSNVKAAWGKVGGNAGAYGAEALERMFLSFPTTKTYFPHFDLSHGSAQVKGHGEKVAAALTKAVGHLDDLPGTLSDLSDLHAHKLRVDPVNFKLLSHSLLVTLACHLPNDFTPAVHASLDKFLANVSTVLTSKYR

SEQ ID NO: 2288 - protein, 145 aa, Ovis aries
MLTAEEKAAVTGFWGKVKVDEVGAEALGRLLVVYPWTQRFFEHFGDLSNADAVMNNPKVKAHGKRVLDSFSNGMKHLDDLKGTFAQLSELHCDKLHVDPENFRLLGNVLVVVLARHHGNEFTPVLQADFQKVVAGVANALAHRYH

SEQ ID NO: 2289 - protein, 136 aa, Ovis aries
LFNTNATIVATLTAACAQHCPEAMICIISNPVNSTIPITAEVFKKHGVYDPNKIFGVTTLDIVRANAFVAELKDLDPARVNVPVIGGHAGKTIIPLISQCTPKVELPQDQLATLTGRIQEAGTEVVKAKAGAGSAT

SEQ ID NO: 2290 - protein, 166 aa, Ovis aries
MSPKKAKKRAEGANSNVFSMFEQTQIQEFKEAFTIMDQNRDGFIDKNDLRDTFAALGRVNVKNEEIDEMLKEAPGPINFTVFLQMFGEKLKGADPEETILNAFKVFDPEGKGVLKADYVKEMLTTQTERFSKDEIEQMFAAFPPDVTGNLDYKNLVHIITHGEEKD

SEQ ID NO: 2291 - protein, 199 aa, Ovis aries; identical to SEQ ID NO: 494

SEQ ID NO: 2292 - protein, 39 aa, Ovis aries
ILGQNGISDVVKVTLTHEEEACLKKSADTLWGIQKELQF

SEQ ID NO: 2293 - protein, 68 aa, Ovis aries
  MOD_RES (42)..(42): Any amino acid
  MOD_RES (57)..(57): Any amino acid
PAWYSIDSRVRGTSLVVKGLKENVEYHFRVSAENQFGISKPXKSEEPVIPKTPLSKXSSNHNTVNFLS

SEQ ID NO: 2294 - protein, 143 aa, Ovis aries
TAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 2295 - protein, 194 aa, Ovis aries
MEEKLKKTKIIFVVGGPGSGKGTQCEKIVQKYGYTHLSTGDLLRAEVSSGSARGKMLSEIMEKGQLVPLETVLDMLRDAMVAKVDTSKGFLIDGYPREVQQGEEFERRIGQPTLLLYVDAGPETMTKRLLKRGETSGRVDDNEETIKKRLETYYKATEPVIAFYEKRGIVRKVNAEGSVDNVFSQVCTHLDALK

SEQ ID NO: 2296 - protein, 314 aa, Ovis aries
MAATASPGASGMDGKPRTSPKSVKFLFGGLAGMGATVFVQPLDLVKNRMQLSGEGAKTREYKTSFHALTSILRAEGLRGIYTGLSAGLLRQATYTTTRLGIYTVLFERLTGTDGTPPGFLLKAVIGMTAGATGAFVGTPAEVALIRMTADGRLPVDQRRGYKNVFNALFRIVQEEGVLTLWRGCIPTMARAVVVNAAQLASYSQSKQFLLDSGYFSDNILCHFCASMISGLVTTAASMPVDIVKTRIQNMRMIDGKPEYKNGLDVLVKVVRYEGFFSLWKGFTPYYARLGPHTVLTFIFLEQMNKAYKRLFLSG

SEQ ID NO: 2297 - protein, 641 aa, Ovis aries
MAKNMAIGIDLGTTYSCVGVFQHGKVEIIANDQGNRTTPSYVAFTDTERLIGDAAKNQVALNPQNTVFDAKRLIGRKFGDPVVQSDMKHWPFRVINDGDKPKVQVSYKGETKAFYPEEISSMVLTKMKEIAEAYLGHPVTNAVITVPAYFNDSQRQATKDAGVIAGLNVLRIINEPTAAAIAYGLHRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTRDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISRLYQGAGGPGAGGFGAQAPKGGSGSGPTIEEVD

SEQ ID NO: 2298 - protein, 131 aa, Ovis aries
QSGRKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 2299 - protein, 316 aa, Ovis aries
GLISLVVKKIGPKGLETEVENGGVLGSRKGVNLPGIEVDLPGLSEQDVQDLRFGVEQGVDIIFASFVRKASDVAAVRAALGPEGQGIKIVSKIENHEGVKKFDEILAVSDGIMVARGDLGIEIPAEKVFLAQKMMIGRCNLAGKPVVCATQMLESMITKPRPTRAETSDVANAVLDGADCIMLSGETAKGSFPVEAVKMQHAIAREAEAAVYHRQLFEELRRAAPLSRDPTEVTAIGAVEAAFKCGAGAIIVLTTTGRSAQLLSRYRPRAAVIAVTRSAQAARQAHLCRGVFPVLYREPPEDIWADDVDRRVQFGI

SEQ ID NO: 2300 - protein, 447 aa, Ovis aries
MAVAAAAARVWRPSRGLGRAGLPLLRLLGARGLARSHTHRWQQQRHFSSLDDKPQFPGASAEFIDKLEFIQPNVISGIPIYRVMDRQGQIINPSEDPHLPQEKVLKFYKSMTLLNTMDRILYESQRQGRISFYMTNYGEEGTHVGSAAALDDTDLVFGQYREAGVLMYRDYPLELFMAQCYGNVSDLGKGRQMPVHYGCRERHFVTISSPLATQIPQAVGAAYAAKRANANRVVICYFGEGAASEGDAHAGFNFAATLECPIIFFCRNNGYAISTPTSEQYRGDGIAARGPGYGILSIRVDGNDVFAVYNATKEARRRAVAENQPFLIEAMTYRIGHHSTSDDSSAYRSVDEVNYWDKQDHPISRLRHHLQSRGWWDDEQEKAWRKQSRKKVMEAFEQAERKLKPNPNLIFSDVYQEMPAQLRKQQESLARHLQTYGEHYPLDHFEK

SEQ ID NO: 2301 - protein, 108 aa, Ovis aries
YALKSMTEAEQQQLIDDHFLFDKPVSPLLLASGMARDWPDARGIWHNDNKTFLVWINEEDHLRVISMQKGGNMKEVFTRFCNGLTQIETLFKSKNYEFMWNPHLGYIL

SEQ ID NO: 2302 - protein, 147 aa, Ovis aries
KFSRDVFLPKPTWGNHTPIFRDAGMQLQSYRYYDPKTCGFDFTGAIEDISKIPAQSVILLHACAHNPTGVDPRPEQWKEMATVVKKNNLFAFFDMAYQGFASGDGNKDAWAVRHFIEQGINVCLCQSYAKNMGLYGERVGAFTVVCK

SEQ ID NO: 2303 - protein, 175 aa, Ovis aries
MDIAIHHPWIRRPFFPFHSPSRLFDQFFGEHLLESDLFPASTSLSPFYLRPPSFLRAPSWIDTGLSEVRLEKDRFSVNLDVKHFSPEELKVKVLGDVIEVHGKHEERQDEHGFISREFHRKYRIPADVDPLTITSSLSSDGVLTMNGPRKQASGPERTIPITREEKPAVTAAPKK

SEQ ID NO: 2304 - protein, 227 aa, Ovis aries; identical to SEQ ID NO: 486

SEQ ID NO: 2305 - protein, 245 aa, Ovis aries
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNRSQPESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 2306 - protein, 1481 aa, Ovis aries
MQRSPLEKASVVSKLFFSWTRPILKKGYRQRLELSDIYHISSSDSADNLSEKLEREWDRELASKKNPKLINALRRCFFWRFMFYGIILYLGEVTKAVQPLLLGRIIASYDPDNKVERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVTLLMGLLWDLLQAFTFCGLAFLVVLALLQAGLGKMMMKYRDQRAGKINERLVITSEMIENIQSVKAYCWEEAMEKIIENLRQTELKLTRKAAYVRYLNSSAFFFSGFFVVFLSVLPYALLKGIILRKIFTTISFCIVLRMAVTRQFPWAVQTWYDSLGAINKIQDFLQKQEYKTLEYNLTTTDVVMENVTAFWEEGFSKLFEKAKENNNNRKISNCDTSLFFSNLLLGTPVLKDISFKIERGQLLAVAGSTGAGKTSLLMMIMGELEPSEGKIKHSGRISFCSQYSWIMPGTIKDNIIFGVSYDEYRYRSVIKACQLEEDISKFSEKDNIVLGEGGITLSGGQRARISLARAVYKDADLYLLDSPFGYLDVLTEKEIFESCVCKLMANKTRILVTSKMEHLKKADKILILHEGSVYFYGTFSELQNQRPDFSSKLMGCDTFDQFTAERRNSIITETLRRFSLEGDTSVSWNETKKPSFKQTGEFGEKRKNSILNSINSIRKFSVVQKTSLQMNGIDGASDEPLERRLSLVPHSEPGEGILPRSNAVNSGPTFLGGRRQSVLNLMTCSSVNQGQSIHRKTATSTRKMSLAPQASLAEIDIYSRRLSQDTGLEISEEINEEDLRDCFFDDVENIPAVTTWNTYLRYITVHKSLMFVLIWCLVVFLVEVAASLVVLCLFPKILLQDKGNSTKNASNSYAVIITSTSSYYIFYIYVGVADTLLALGLFRGLPLVHTLITVSKTLHHKMLQSVLQAPMSTLNTLKTGGILNRFSKDIAVLDDLLPLTIFDFIQLLLIVIGAVVVVSVLQPYIFLATVPVIAAFILLRGYFLHTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMGTLQWAVNSSIDVDSLMRSVSRVFKFIDMPTEDGKPNNSFRPSKDSQPSKVMIIENQHVKKDDIWPSGGQMTVKDLTAKYIDGGNAILENISFSISPGQRVGLLGRTGSGKSTLLLAFLRLLNTKGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPITYQIIRRTLKQAFADCTVILSEHRIEAMLECQRFLVIEENKVRQYDSIQRMLSEKSLFRQAISPADRLKLLPHRNSSRQRSRANIAALKEETEEEVQETKL

SEQ ID NO: 2307 - protein, 3127 aa, Ovis aries
MATLEKLMKAFESLKSFQQQQQQQQQQPPPPPPQPPQPPPPPQAQPPPQPPPPPPPPPVGPAAAEEPLHRPKKELSATKKDRVNHCLTICENIVAQSLRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAIPKIMASFGNFANDNEIKVLLKAFIANLKSSSPTVRRTAAGSVVSICQHSRRTQYFYSWLLSVLLGLLVPVEEEHPTLLILGVLLALRSLVPLLQQQVKDTSLKGSFGVTRKETEVSPSTEQLVQVYELTLHYTQHQDHNVVTGALELLQQLLRTPPPELLRALTTAGGVRQLAAAKDEPGGRSRSGSIVELIAGGGSSCSPVLSRKQKGKVLFGEAAPLEDDSESRSEGSSPAFSASAKGEAGGELAASSGVSTPGSTSSAADSAGHGIITEQPRSQHTRQTDSVDLAACDLTSAATDGDEEDILSRSSSQMSAVPSDPAMDLNDGTQASSPISDSSQTTTEGPDSAVTPSDSSEIVLDGPDSQYPGMPAGQMQDEDGDATAVLPDDAEAFRNSSIALQQAHLLKSMGHSRQASDSSVDKFVSREEAAEPGDPESKPWRVKGDIGQSTDEDSAPLVHCVRLLSASFLLTGEKNALVPDRDVRVSVKALALSCVGAAVALHPESFFSKLYRAPLDTVEFPEEQYVSDVLNYIDHGDPQVRGATAILCGTLVCSVLGRCRFHVAGWMGAVRARTGNTFSLADCIPLLQKTLKDESSVTCKLACAAVRLCVMSLCSSSYSAWGLQLITDLLALRSSSYWLVRTELLETVAEIDFRLVSFLEAKAESLHRGAHHYTGRLKLQERVLSNVVIHLLGDEDPRVRHVAAASLMRLVPKLFYKCDRGQADPVVVVARDQSSVYLALLMHEPQPPSHLSVSAATRIYRGYNLLPSITDVTLENNLSRVIAAVSHELIMSTTRALTFGCCEALCLLSTAFPVCIWSLGWHCGVPPLSASDESRKSCTVGMVTMILTLLSSAWFPLDLSAHQDALILAGNLLAASAPRSPRSSWASEDEASTAASKQEEAWPALGDRTLVPMVEQLFSHLLKVINICAHVLDDVAPGPAVKAALPSLTNPPSLSPIRRKGKEKEPGEQASVPVSPKKGGESSPASRPPETSGPVATNKSSSLGSFCHLPSYLKLHDVLKATHANYKVTLDLQSSSEKVGGFLRSALDVLSQILELATLQDIGKCVEEILGYLKSCFSREPMMATVCVQQLLKTLFGTNLASQLDGLSSHASKSQGRAQRLGSSSARPGLYHYCFMAPYTLFTQALADASLRNAAQAEQDQDTAGWFDVLQKVSTQLKTNLTSVSKNRADKNAIHNHIRLFEPLVIKALKQYTTTTSVRLQKQVLALLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGRELETQKEVVVSMLLRLIQYHQVLEMFTLVLRQCHKESEDRWKRLSRQVADVILPMLAKQQVHIDSHEALGVLNTLFEILAPSSLRPVDMLLRSMFVTPDTLAVVSTVQLWVSGILAILRVLISQSTEDIVLSRIQELSFSPNLVSCSTISRLRDGDSASAPEELSEGRQTKNLPEETFARFLLQLVGILLEDIVTKQLRVEVSEQQHTFYCQELGTLLMCLIHIFKSGTFRRITAAASRLLRDGADGGFYSLESLNARVRSVIPTHPALVLLWCQILLLVGHTDYRWWAEVQQTPKRRSLSSTKSLSPETSGEDEDPDVASKLGMCNREIVRRGALILFCDYVCQNLHDSEHLTWLIVNHIQDLISLSHEPPVQDFISAVHRNSAASGLFIQAIQSRCENLSTPTMLKRTLQCLEGIHLSQSGAVLTLYVDKLLCTPLRALARVVETLACRRVEMLLAANLQSSTAQLPAEELIRIQEHLQSSGLAQRHQRLYSLLDRLRLATAPGSHGPTPPVTSHPLDGDGPLALEAVNPDKDWYVQLVQAQCWTRSDSALLEGAELVSRIPAGDLGAFVMHSEFNLSLLAPCLGLGMREISGGQRSPLFEAARMATLDRVTVVVQQLPAVHQAFQPFLPPQPATYWSKLDDLFGDAALYRTLTTLARALAQYLLVFSRLPSHLQLPPEKERDTVKFVVMTLEALSWHLTHARVPLSLDLQAGLDCCCLALQLPGLWSLLAAPNMVTHACSLIHCVRFILEAIVVQPGDQLLSPESRTSAPRSAREDGVDSDTQTPQYIAAACGMVAEMVECLPSVLALGHKRNSHTPAFLTPVLRNIIISLARLPLVNSYTRVPPLVWKLGWSPKPGGDFGTVFPEIPVEFLQEKEVFKEFIYRINTLGWTSRTQFEETWATLLGVLVTQPLVMEQEESPQEEDVERTQIHVLAVQAITSLVLSAMTVPVAGNPAVSCLEQQPRNKPLKALDTRFGRKLSVIRGIVEQEIQAMVSRRENAATHHLYQAWDPVPSLAPATTGALISHDKLLLQLNPERELGDMSYKLGQVSIHSVWLGNSITPLREEEWDEEEEEAEAPAPSSPPTSPLNSRKHRAGVDIHSCSQFLLELYSRWILPSSSARRTPVTLISEVVRSLLVVSDLFTERNQFEMMYLTLTELRKAHPSEDEILLQYLVPATCKAAAVLGMDKAVAEPVSRLLESALRSSHLPSTMGALHGVLYVLECDLLDDTAKQLIPVVSDYLLSSLQGRAHCVNVHSQQHVLVMCATAFYLIENYPLDVGPEFSASIIQMCGVMLSGSEEATPSVVYHCVLRGLERLLLSEQLSRLDAESLVKLSVDRVNVHSPHRAMAALGLMLTCMYTGKEKVSPGRASEPSPAAPDSESVIVAMERVSVLFDRIRKGFPCEARVVARVLPQFLDDFFPPQDVMNKVIGEFLSSQQPYPQLMATVVYQVFQALHSAGQSSTVRDWVMLSLSNFTQRSPVAMATWSLSCFFVSASTSPWVSAILPHVVSRMGKLEQVDVNLFCLVAADFYRHQIEEELDRRAFQSVFEVVAVPGNPYHHLLACLRSVHKAATC

SEQ ID NO: 2308 - protein, 358 aa, Persea americana
  MOD_RES (94)..(94): Any amino acid
MSAFCGKYQDELIANAAYIGTPGKGILAADESTGTIGKRLASINVENVESNRQALRELLFCTPGALECLSGVILFEETLYQKTASGKPFVDVLXERGVLPGIKVDKGTVELAGTNGENTTQGLDGLAQRCQQYYSAGARFAKWRAVLKISPNEPSQLAINENANGLARYAIICQENGLVPIVEPEILVDGSHDIDRCADVTERVLAACYKALNDHHVLLEGTLLKPNMVTPGSDAKKVTPEVIAEYTVRALQRTTPAAVPAIVFLSGGQSEEEATLNLNAMNKLKGKKPWTLSFSFGRALQQSTLKTWAGKEENVKKAQSAFLSRCKANSEATLGTYKGDAAKGEGVSESLHVKDYKY

SEQ ID NO: 2309 - protein, 462 aa, Persea americana
MALTRLLLPISILWFCFYSSHTILQKDPLLICVNGDPGFDQRAYPTYFGPILDEFSSIMGFEPSILSLERFNPVGGPETSPDTDISVDDFGARGDGTDDTKAFEKAWKDACSSGSVLIVPENKNYLLKQITFSGPCKSDLRVKIRGTIEASSDQSDWVGHNRKRWIEFEDISNLTLEGGGTSNGNGETWWDSSCKRKKSLPCKSAPTALTFRSCKNLIVSDLSIKDSQKMHLSFDKCQDVIASNLMVTAPEHSPNTDGIHITGTQRIHVMNSVIGTGDDCISIESGSKMVIATNITCGPGHGISIGSLGDRNSEAHVSGVLVDGGNLFDTTNGLRIKTWQGGSGSAKNIKFQNIVMHNVTNPIIIDQYYCDSKDPCPEQESAVKVSNVAYMNIRGTSASEVAVKFDCSKSSPCQGYIVGNINLVGNGGKETTMSCSNIVQGLLREGLSTFLFMKRRVHECSY

SEQ ID NO: 2310 - protein, 320 aa, Persea americana
MDSFPVINMEKLEGQERAATMKLINDACENWGFFELVNHSIPVELMDEVERLTKEHYKKCMEQRFKELMASKVEGAVVDANDMDWESTFFIRHLPVSNLSEIPDLTDEHRKVMKEFAEKLEKLAEQVLDLLCENLGLEKGYLKMAFAGTTTGLPTFGTKVSNYPPCPRPELFKGLRAHTDAGGLILLFQDDRVAGLQLLKDGEWVDVPPMNHSIVINLGDQVEVITNGKYKSVMHRVVAQTDGNRMSLASFYNPGSDAVIFPAPALVEKEAEEKKEVYPKFVFEDYMNLYAGLKFQAKEPRFEVMKMKAVETANLSPITT

SEQ ID NO: 2311 - protein, 502 aa, Persea americana
MAILVSLLFLAIALTFFLLKLNEKREKKPNLPPSPPNLPIIGNLHQLGNLPHRSLRSLANELGPLILLHLGHIPTLIVSTAEIAEEILKTHDLIFASRPSTTAARRIFYDCTDVAFSPYGEYWRQVRKICVLELLSIKRVNSYRSIREEEVGLMMERISQSCSTGEAVNLSELLLLLSSGTITRVAFGKKYEGEEERKNKFADLATELTTLMGAFFVGDYFPSFAWVDVLTGMDARLKRNHGELDAFVDHVIDDHLLSRKANGSDGVEQKDLVDVLLHLQKDSSLGVHLNRNNLKAVILDMFSGGTDTTAVTLEWAMAELIKHPDVMEKAQQEVRRVVGKKAKVEEEDLHQLHYLKLIIKETLRLHPVAPLLVPRESTRDVVIRGYHIPAKTRVFINAWAIGRDPKSWENAEEFLPERFVNNSVDFKGQDFQLIPFGAGRRGCPGIAFGISSVEISLANLLYWFNWELPGDLTKEDLDMSEAVGITVHMKFPLQLVAKRHLS

SEQ ID NO: 2312 - protein, 100 aa, Persea americana
PLLGGVRDVPDHNSAETEELARFAVQEHNKKANTRLEFSRVVKAKEQVVAGTMYYITLEVVEAGQKKIYEAKVWVKLWENFKELQEFKPVGDSSSTSSDA

SEQ ID NO: 2313 - protein, 396 aa, Persea americana
MALKLSPVMFQSQKLPFLASYPPSNLRSPRVFMASTLRSSTKEVDNIKKPFSPPREVHVQVTHSMPPQKIEIFKSLEDWAEENILVHLKPVEKCWQPQDFLPEPESEGFLESVEELRKRAKEIPDEYFVCLVGDMITEEALPTYQTMLNTLDGVRDETGASPTSWAIWTRAWTAEENRHGDLLNKYLYLSGRVDMRQIEKTIQYLIGSGMDPRTENSPYLGFVYTSFQERATFISHGNTARHAKEYGDDKLAKICGTIAADEKRHETAYTKIVEKLFEIDPDGTVLAFCDMMKKKISMPAHLMYDGQDDDLFGHFSSVAQRLGVYTAKDYADILEFLVRRWDVEHLTGLSPEGKTAQEFICKLAPRIRSLEERARSRAKEGPTIPFSWIFNREVKL

SEQ ID NO: 2314 - protein, 779 aa, Persea americana
  MOD_RES (260)..(260): Any amino acid
  MOD_RES (370)..(370): Any amino acid
  MOD_RES (377)..(377): Any amino acid
  MOD_RES (379)..(379): Any amino acid
  MOD_RES (652)..(652): Any amino acid
MTVTPKISINDGNLVVHGKTILTGVPDNIVLTPRTGDGLVAGCFIGATASESESIHVFPMGTLEGLRFTCCFRFKLWWMTQRMGMCGKDVPLETQFMLIESKDGAAAIDDDEEEAPTIYTVFLPLLEGQFRAVLQGNESNQIEICLESGDCAVRTNQGMYLVYMHAGTNPFQVINQAVKAVEKHLYSFQHLEKKKIPSFLDWFGWCTWDAFFTDVTDEGVEEGLKSLSGGGTPPRFLIIDDGWQQIGSEETKDDSNCVVXEGAQFASRLTGIKENDKFQKNGKSEHVPGLKLVVDDAKQHHNVKFVYVWHALAGYWGGVKPPAAGMEHYDTALAYPVQSPGVMGNQPDIVMDSLSVHGLGLVHPRKVFNXYNELHAXLXSCGVNGVKVDVQNIIETLGAGHGGRVSLTRSYIQALEGSIARNFPDNGCIACMCHNTDSIYSAKQTAVVRASDDFYPRDPASHTIHVSSVANNSLFLGEFMQPDWDMFHSLHPAAEYHGAARAVGGCPIYVSDKPGHHNFELLKKLVLPDGSVLRARLPGRPTRDSLFVDPARDGVSLLKIWNMNKCLGVVGVFNCQGAGWCKITKKTRIHDAAPGTLSGSIRAHDVEFINQLAGQDWNGEVIVFTYGSGEVVRLPKCASIPVTLEVLEYELXHICPVKEITSNISFAPIGLLDMFNSGGAVEQFDVRMDSNNAEPPLFDGKVASKLSSSLSNNQSPSATVVLRVRGCGRFGAYSSQRPLKCTVDLVETEFNYDSVTGLVTLIIPVPDQEMYKWSVEFQL

SEQ ID NO: 2315 - protein, 326 aa, Persea americana
MVYCTASLPLLLLLLVGLLAGEAFAEQCGRQAGGALCPGGLCCSQFGWCGSTSDYCGPTCQSQCGGVTPSPGGGVASLISQSVFNQMLKHRNDAACQAKGFYTYNAFIAAANSFNGFASVGDTATRKREIAAFLAQTSHETTGGWATAPDGPYAWGYCFLKEQGNPPDYCVPTAQWPCAPGKKYYGRGPIQISYNYNYGPAGRAIGYDLINNPDAVATDPVISFKTALWFWMTPQSPKPSCHNVITGRWTPSAADRAAGRLPGYGVITNIINGGIECGKGFNDKVADRIGFYKRYCDLLGVSYGSNLDCYNQRSFGVSTNPLAASS

SEQ ID NO: 2316 - protein, 181 aa, Persea americana
VNMATGDHKKEPFISLNPFGQVPALEDGDLKLFESRAITNYISHEYAGKGTDLICKDSKKMAIVAVWMEVEAHHFDPEASKLVWELFYKPIYGLTTDPAAVTALSEKLAKVLDVYEGPLAHSKYLGGDCFHFADLHHLPCLNYLMTTQVKELFDSRLHVSAWCQDILARPAWAKVVEMQKK

SEQ ID NO: 2317 - protein, 433 aa, Vaccinium corymbosum
MVHSFKYILIGGGVSAGYAAREFVKQGVHPGELAIISKEAVAPYERPALSKAYLFPESPARLPGFHTCVGSGGERLLPEWYSEKGIQLYLSTEIVSADLAAKFLKSANGEHFEYHILIIATGSSVIRLTDFGVQGADAKHIYYLREIDDADKLYEAIKQKKNGKVVIVGGGYIGLELSAVMKLNNLDVCMVYPEPWCMPRLFTAGIAAFYEGYYAHKGIKIIKGTVAVGFTSDANGEVKEVKLKDGRVLESDIVVVGVGGRPLIGLFKGQVEEEKGGIKTDSFFKSSVPDVYAVGDVATFPMKIYNEMRRVEHVDHARKSAEHAVKAIFAADEGTSVEEYDYLPFFYSRSFNLSWQFYGDNVGETVLFGDSSPTSENPKFGTYWIKDGKIVGAFLESGTPEENKAIANLSRVQPPADSLDQLAKEGITFACKI

SEQ ID NO: 2318 - protein, 108 aa, Vaccinium corymbosum; identical to SEQ ID NO: 585

SEQ ID NO: 2319 - protein, 479 aa, Brassica oleracea
MSPQTETKASVGFKAGVKEYKLNYYTPEYETKDTDILAAFRVTPQPGVPPEEAGAAVAAESSTGTWTTVWTDGLTSLDRYKGRCYHIEPVPGEETQFIAYVAYPLDLFEEGSVTNMFTSIVGNVFGFKALAALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHVHAGTVVGKLEGDRESTLGFVDLLRDDYVEKDRSRGIFFTQDWVSLPGVLPVASGGIHVWHMPALTEIFGDDSVLQFGGGTLGHPWGNAPGAVANRVALEACVQARNEGRDLAVEGNEIIREACKWSPELAAACEVWKEITFNFPTIDKLDGQD

SEQ ID NO: 2320 - protein, 466 aa, Brassica oleracea
  source: /note="var. alboglabra"
MALIVEKTSSGREYKVKDMSQADFGRLELELAEVEMPGLMACRTEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQESGALLFPAINVNDSVTKSKFDNLYGCRHSLPDGLMRATDVMIAGKVAVICGYGDVGKGCAAAMKTAGARVIVTEIDPICALQAMMEGLQVLTLEDVVSEADIFVTTTGNKDIIMVDHMRKMKNNAIVCNIGHFDNEIDMQGLETFPGVKRITIKPQTDRWVFPDTKSGIIVLAEGRLMNLGCATGHPSFVMSYPFTNQVIAQLELWNEKSSGKYEKKVYVLPKHLDEKVAALHLGKLGAKLTKLTKDI

SEQ ID NO: 2321 - protein, 347 aa, Brassica oleracea
MGRKKLELSERHSVAMAASLQSAATFFQSAKISTAPSRGSAHLRSAQTVGKSFGLETSSARLTCSYQSDIKDFAGKCSDAVKIAGFALATSALVVSGASAEGAPKRLTYDEIQSKTYMEVKGTGTANQCPTIDGGSETFSFKPGKYAGKKFCFEPTSFTVKAESVSKNAPPEFQNTKLMTRLTCTLDEIEGPFEVSSDGSVNFKEEDGIDYAAVTVQLPGGERVPFLFTVKQLDASGKPDNFTGKFLVPSYRGPSFLDPKGRGGSTGYDNAVALPAGGRGDEEELSKENVKNTAASVGEITLKVTKSKPETGEVIGVFQSLQPSDTDLGAKVPKDVKIQGVWYGQLE

SEQ ID NO: 2322 - protein, 250 aa, Brassica oleracea
MAKTSLPLAASFLLLLISSAAAADAGRLFLTVVNHCPFTVWPAIQPNAGHPVLEKGGFALPTNTHRSFFPPSTHWSGRIWGRTGCSHYNGKFSCVTGDCGHRLECNGLGGATPASLAQFDLHHGGHQDLSSYGVSLVDGFNVPMTVTPHEGRGVCPVVGCREDLLKTCPAHLQLRSHGGHVVACKSGCEAFRTDELCCRNHYNSPQTCRASSHSLFFKHACPSTMTFAHDSPSLMHDCSSPRELKVIFCH

SEQ ID NO: 2323 - protein, 250 aa, Brassica oleracea
  source: /note="var. italica"
MTKNYPAVSEEYQKAIEKCKRKLRGLIAEKNCAPIMVRLAWHSAGTFDCASRTGGPFGTMRFDDELAHGANNGLHIALRLLEPIREQFPTISHADFHQLAGVVAVEVTGGPEIPFHPGREDKPQPPPEGRLPDATKGCDHLRQVFLKQMGLTDQDIVALSGAHTLGRCHKDRSGFEGAWTSNPLIFDNSYFKELLSGEKEGLFQLPSDKALLDDPVFRPLVEKYAADEEAFFTDYAEAHLKLSELGFADA

SEQ ID NO: 2324 - protein, 354 aa, Brassica oleracea
FEKPSAIQQRGIIPFCKGLDVIQQAQSGTGKTATFCSGVLQQLDYTLVQCQALVLAPTRELAQQIEKVMRALGDYLGVKVHACVGGTSVREDQRILQSGVHVVVGTPGRVFDMLRRQSLRADAIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTTDDERMLSDIQKFYNVVVEELPSNVADLL

SEQ ID NO: 2325 - protein, 446 aa, Brassica oleracea
  source: /note="var. botrytis"
MREILHIQGGQCGKQIGSKFWEVVCDEHGPTGRYTGNSYLQLERVNVYYNEASCGRYVPRAILMDLEPGTMDSVRTGPYGQIFRPDNFVFGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMINVQNKNSSYFVEWIPNNVKSSVCDIAPRGLSMASTFIGNSTSIQEMFRRVSEQFTAMFRRKAFLHWYTGEGMDEMEFTEAESNMNDFVSEYQQYQDATADEEGEYEEEEEEEVEYQD

SEQ ID NO: 2326 - protein, 891 aa, Brassica oleracea
  source: /note="var. gemmifera"
MFCKEASSSLQTLNIAKSLSSEFTKPSALINPLSAGHRYKLCPRPNLRGRCTVTASKFDIDWIAKERVKKIKVKGIITAKQGLLPSVGFTDLLGVSLLVELISAETDPQTLMEKDPVKDHARRLVIDAHGEDQYECVFDMPKDFGAVGAIRVLNEAHREIFLKEMKLELPDGPVTFTCNSWLASKSDDPTKRTFFSNKSYLPLQTPEPLKQLRKEELETLQGKNRERNGELKKFERVYDYDVYNDVGDPDKDPKLSRPVLGGLSHPYPRRCKTGRKPSRKYPSIETRKGDFYVPRDEEWSTVKGTAFTGTTILAALPAVFPQIEAALVDPNMPFPHFKSIEDLFEEGIELPKNAGIFPLIPRVVKAVAEADDILQFDSPILLDKDRFSWIRDDEFARQTLAGLNPLCIGLVQEWPLKSKLDPAVYGDPNSLITSEIVEREIKGVMSFDEALENKRLFMLDYHDLLLPYVNKVRELDDSTLYASRTLFFLNDDSTLRPVAIELTRPQDVNRPQWSQVFTPGYDATSCWLWNLAKTHAITHDAGYHQLISHWLRTHCCMEPYIIAANRQLSAMHPIYRLLHPHFRYTLEINARARQSLVNAGGIIETCFWPGKYSLELSSDVYAKLWRFDREGLPADLISRGLAVEDETAEHGLRLTIPDYPFANDGLMLWDALKEWITECVKHYYPDAALIMCDEELQAWWSEVRNIGHGDKKDEPWWPVLRTQDDLIGVVTTIAWVASGHHAAVNFGQYGYGGYFPNRPTTTRIRMPVEEPTEEELKEFYEEPEKVLLKTFPSQKQATQVMVTLDLLSTHSPDEEYLGEEPEASWVDDPVIFAAYERFKGRLKHLEDVIDERNVNVSLKNRAGAGVVKYELLKPISQPGVTGMGVPYSVSI

SEQ ID NO: 2327 - protein, 218 aa, Brassica oleracea
MKTFFLVTLLLAAAVCTHGREQVKDSNGNPVKRGAKYFIQPAKSNGGGLVPAAINILPFCPLGITQTLLPYQPGLPVSFGYEPVIVGTDYIYTSTTINIEFRSEIWPVCNELSKLWAVDVSSSAAKEPAIIIGGERTAPNSLFKIEEATGAHTYKLTTSSGTVGTIPGPWLGAPQLIATNDDAKTLFVKFVKVDDDATKATTSTSRVEKLGLRMFPFY

SEQ ID NO: 2328 - protein, 202 aa, Brassica oleracea
DQVVYILDQVRAMETEMLQRIQQQGLNITPRILILTRLLPDAVGTTCGERLERVDGSEYCDILRVPFRTEKGIVRKWISRFEVWPYLETYTEDAAVELAKELRGKPDLIIGNYSDGNLVASLLAHKLGVTQCTIAHALEKTKYPDSDIYWKKLDDKYHFSCQFTADLFAMNHTDFIITSTLPEIAGSKDTVGQYESHTAFTL

SEQ ID NO: 2329 - protein, 226 aa, Brassica oleracea
  source: /note="var. botrytis"
MMSSFPLVSFLITLMLAAAVCTHGENRVNDTDGNPLRTTAQYLILPLSPRSNGGGLLPVPVKLQPLCPLGISQSSVKALPGLPVSFSYPYAIMDTYVNEMEAINIEFKSDAWPGCEEFSKYWEVDESSSASEEPAILVGGKKHERNSWFKIERKEPFYGGIAYKLTTLTGTIGTVPGPWENAPQLVLTDDTAKTFLVKFHKVHGDTTATTSTSRQEKLGLRMFPFY

SEQ ID NO: 2330 - protein, 282 aa, Brassica oleracea
  source: /note="var. gemmifera"
MAENADLVEWPKKDKRRFLHVVYRVGDLDRTIQFYTECFGMKVLRKRDVPEEKYSNAFLGFGPETSNFVVELTYNYGVSSYDIGTGFGHFAISTQDVSKMVEAVRAKGGNVTREPGPVKGGGSVIAFVKDPDGYTFELIQRGPTPEPLCQVMLRVGDLDRAVKFMEKALGMRLLRRIERPEYNTIGMMGYAEEYESIVLELTYNYGVTEYTKGNAYAQIAIGTDDVYKSAEVVKIVNQELGGKITREAGPLPGLGTKIVSFLDPDGWKQVLVDNEDFLKELE

SEQ ID NO: 2331 - protein, 95 aa, Brassica oleracea; identical to SEQ ID NO: 560

SEQ ID NO: 2332 - protein, 152 aa, Brassica oleracea
  source: /note="var. capitata"
MAKGVAVLNSSEGVKGTIFFTHEGNGATTVTGTVSGLRPGLHGFHVHALGDNTNGCMSTGPHFNPDGKTHGAPEDANRHAGDLGNIIVGDDGTATFTITDSQIPLSGPNSIVGRAIVVHADPDDLGKGGHELSLSTGNAGGRVACGIIGLQG

SEQ ID NO: 2333 - protein, 168 aa, Brassica oleracea
MLVYTDLLTGDELLSDSFPYKEIENGILWEVEGKWTTKGCVEVNIGANPSAEEGGEDEGVDDSVEKVVDIVDTFRLQEQPTYDKKGFIAYIKKYIKLLTPKLTPEQQEEFKKGIEGATKFLLPKLKDFQFFVGEGMHDDSTIVFAYYKEGATNPTFLYFAHGLKEVKC

SEQ ID NO: 2334 - protein, 322 aa, Brassica oleracea
  source: /note="var. acephala"
GHASTSTSPVFVQAPSEKGFSSFAIDFLMGGVSAAVSKTAAAPIERVKLLIQNQDEMLKAGRLSEPYKGIGDCFGRTIKDEGFGSLWRGNTANVIRYFPTQALNFVFKDYFKRLFNFKKDRDGYWKWFAGNLGSGGAAGASSLLFVYSLDYARTRLANDSKAAKKGGERQFNGLVDVYKKTLKSDGIAGLYRGFNISCVGIIVYRGLYFGLYDSLKPLLPADLQDSFFASFALGWLITNGAGLASYPIDTVRRRMMMTSGEAVKYKSSMDAFQQILKKEGPKSLFKGAGANILRAIAGAGVLSGYDKLQLLLLGKKYGSESG

SEQ ID NO: 2335 - protein, 536 aa, Brassica oleracea
MDASMITNPKSIVSLPSLFMGRSGGSIRSSQCNVTMGQAVSFPSQKTKTLKVSRNVKRRSGGGGAFAATCSSGDKILVANRGEIAVRVIRTAHEMGIPCVAVYSTIDKDALHVKLADEAVCIGEAPSNQSYLLIPNVLSAAISRGCTMLHPGYGFLAENALFVEMCREHRINFIGPNPDSIRVMGDKSTARETMKNAGVPTVPGSDGLLQSTEEGVRLANEIGYPVMIKATAGGGGRGMRLANEPSEFVKLLQQAKSEAAAAFGNDGVYLEKYVQNPRHIEFQILADKFGNVVHFGECDCSIQRRNQKLLEEAPSPALTPELRKAMGDAAVAAAASIGYIGVGTVEFLLDERGSFYFMEMNTRIQVEHPVTEMIYSVDLIEEQIRVAMGEKLRYTQDEIVLRGHSIECRINAEDPFKGFRPGPGRITSYLPSGGPFVRMDSHVYPDYVVPPSYDSLLGKLIVWAPTRERAIERMKRALNDTIITGVPTTIEYHKLILEVEDFKNGKVDTAFIPKHEEELAEPHEIVPVKDLTNVAA

SEQ ID NO: 2336 - protein, 316 aa, Brassica oleracea
  source: /note="var. capitata"
MASLKVPSNVPLPEDDAEQLHKAFSGWGTNEKLIISILAHRNSAQRSLIRSVYAATYNEDLLKALDKELSSDFERAVMLWTLDPAERDAYLAKESTKMFTKNNWVLVEIACTRSAVELFKVKQAYQARYKKSLEEDVAQHTSGDLRKLLLPLVSTFRYEGDDVNMMLARSEAKLLHEKVSEKAFNDDDFIRILTTRSKAQLGATLNHYNNEHGNSINKNLKEGSDDEYLKLLRAAITCLTYPEKHFEKVLRLAINKMGTDEWGLTRVVTTRTEVDMERIKEEYQRRNSVPLDRAVAKDTSGDYEDMLVALLGHGDV

SEQ ID NO: 2337 - protein, 343 aa, Brassica oleracea
  source: /note="var. italica"
MAPSVQGEWIKVEQKGGQTPGPRSSHGIAVVGDKLYSFGGELTPNISIDKDLYVFDFNTHTWSISPSKGVAPDVKALGTRMVSVGTKLYLFGGRDENKKFDDFYSYDTVTNEWTKLTILDQEGGPEARTYHSMASDENHVYVFGGVSKGGTNKTPFRFRTIEAYNIADGKWSQLPDPGEQFPRFERRGGAGFVVVQGKIWVVYGFATSPDPNGKNDYESDQVQFYDPATQKWTEVETKGDKPSARSVFGHAVVGKYILIFGGETWPDPKAHLGPGTLSDEGFALDTETLVWERFGGGAEPGQLGWPGYTTATVYGKKGLLMHGGKRPTNNRTDELYFYAVNSA

SEQ ID NO: 2338 - protein, 434 aa, Brassica oleracea
MAEKSFKYIILGGGVSAGYAAKEFANQGVKPGELAVISKEAVAPYERPALSKGYLFPEGAARLPGFHCCVGSGGEKLLPESYKQKGIELILSTEIVKADLAAKTLVSAAGDVFKYETLIIATGSTVLRLTDFGVKGADSTNILYLREIDDADKVVEAIKAKKGGKAVVVGGGYIGLELSSALRINDFDVTMVFPEPWCMPRLFTADIAAFYETYYTNKGVKIIKGTVASGFTAHPNGEVNEVQLKDGRSLEADIVIVGVGAKPLTSLFKGQVEEDKGGIKTDAFFKTSVPDVYAVGDVATFPLKMYGDMRRVEHVDHSRKSAEQAVKAIKAAEGGGTVEEYDYLPFFYSRSFDLSWQFYGDNVGDSVLFGDSNPSNPKPRFGAYWIQDGKVVGAFMEGGCGDENKALAKVAKARPVAESLDELAKQGISFAAKI

SEQ ID NO: 2339 - protein, 810 aa, Brassica oleracea
  source: /note="var. capitata"
MAQHLLHGTLHATIYEVDDLHTGGLRSGFFGKILANVEETIGVGKGETQLYATIDLQRARVGRTRKIKDEAKNPKWYESFHIYCAHLASDIIFTVKDDNPIGATLIGRAYVPVDQVIHGEEVDQWVEILDNDRNPIHGGSKIHVKLQYFGVEADRNWNQGIKSAKFPGVPYTFFSQRQGCKVSLYQDAHIPDNFVPRIPLAGGKNYEPQRCWEDIFDAISNAQHMIYITGWSVYTEIALVRDSRRPKPGGDVTVGELLKKKASEGVRVLLLVWDDRTSVDVLKKDGLMATHDEETENFFRGSDVHCILCPRNPDDGGSIVQNLQVSAMFTHHQKIVVVDSEMPSRGGSQMRRIVSFVGGIDLCDGRYDTPFHSLFRTLDTVHHDDFHQPNFTGAAITKGGPREPWHDIHSRLEGPIAWDVLYNFEQRWSKQGGKDILVKLRELSDIIITPSPVMFQEDHDVWNVQLFRSIDGGAAAGFPESPEAAAEAGLVSGKDNIIDRSIQDAYIHAIRRAKDFIYIENQYFLGSSFAWAADGITPEDINALHLIPKELSLKIVSKIEKGEKFRVYVVVPMWPEGLPESASVQAILDWQRRTMQMMYKDIVQALRAQGLEEDPRNYLTFFCLGNREVKKEGEYEPAERPDADSSYMKAQEARRFMIYVHTKMMIVDDEYIIIGSANINQRSMDGARDSEIAMGGYQPHHLSHRQPARGQIHGFRMSLWYEHLGMLDETFLDPSSVECIEKVNRISDKYWDLYSSESLEHDLPGHLLRYPVDVDGEGDVTEFPGFEFFPDTKARILGTKSDYLPPILTT

SEQ ID NO: 2340 - protein, 506 aa, Chlorella vulgaris
MVKIRPDEISSIIKQQIEQYQQEVKAVNVGTVFQVGDGIARIYGLDKVMAGELVEFEDGTVGIALNLEAKNVGAVLMGEGTRVQEGSSVRATGKIAQIPVGDGYLGRVVNSLARPIDGKGEIATKENRLIESPAPGIISRRSVHEPLQTGIVAIDAMIPIGRGQRELIIGDRQTGKTAIAVDTILNQKGKDVVCVYVAIGQKASSIAQVVNTLQERGAMDYTIIVAATADSPATLQYLSPYTGAALAEYFMYTGRHTLVIYDDLTKQAQAYREMSLLLRRPPGREAYPGDVFYLHSRLLERAAKLNDKLGSGSMTALPVVETQEGDVSAYIPTNVISITDGQIFLSADIFNAGIRPAINVGISVSRVGSAAQPKAMKQVAGKLKLELAQFAELEAFSQFASDLDQATQNQLARGQRLRELLKQSQSSPLSLEDQVASIYAGTNGYLDVLPADRVRAFLVGLRQYLATNKAKYGEILRSTNALTDEAQTLLKEALKEYTEEFLASAK

SEQ ID NO: 2341 - protein, 508 aa, Chlorella vulgaris
MGLPWYRVHTVVLNDPGRLIAVHLMHTSLVSGWAGSMAFYELAVFDPSDPVLNPMWRQGMFVLPFMTRLGITQSWGGWTISGETAANPGVWSYEGVAAAHIVLSGLLFAASIWHWVYWDLELFRDPRTSNPALDLPKIFGIHLFLSGVLCFGFGAFHVTGIFGPGIWVSDPYGITGTVQAVAPSWDATGFDPYNPGGISAHHIAAGILGVLAGLFHLCVRPPQRLYNGLRMGNIETVLSSSIAAVFWAAFVVSGTMWYGSAATPIELFGPTRYQWDLGFFQQEIERRVQTNLSEGKSASQAWAEIPEKLAFYDYIGNNPAKGGLFRAGAMNSGDGIAVGWLGHAVFKEKQGNELFVRRMPTFFETFPVVLVDKDGVVRADVPFRRSESKYSIEQVGVSVTFYGGELDGVTFNDPATVKKYARRAQLGEIFEFDRATLQSDGVFRASPRGWFTFAHLCFALLFFFGHIWHGARTIFRDVFAGIDADLDEQVEFGAFLKLGDTSTRRQSV

SEQ ID NO: 2342 - protein, 473 aa, Chlorella vulgaris
MKNLYSLRRFYHVETLFNGSLVVGGRDQESTGFAWWAGNARLINLSGKLLGAHVAHAGLIVFWAGAMNLFEVAHFVPEKPMYEQGLILLPHLATLGYGVGPGGEVIDTYPYFVSGVLHLISSAVLGFGGVYHSLVGPETLEESFPFFGYVWKDKNKMTTILGIHLIVLGFGAWLLVWKAMYFGGIYDTWAPGGGDVRIISNPTVSPGVIFSYILKSPFGGDGWIVSVDNMEDVIGGHIWIGTLCIFGGIWHILTKPWAWARRAFVWSGEAYLSYSLGAIALMGFTACCMSWFNTTAYPSEFYGPTGPEASQSQTFTFLVRDQRLGANVASAQGPTGLGKYLMRSPTGEIIFGGETMRFWDFRGPWLEPLRGPNGLDLNKLKNDIQPWQERRAAEYMTHAPLGSLNSVGGVATEINAVNYVSPRSWLATSHFCLGFFFFVGHLWHAGRARAAAAGFEKGIDRDNEPVLSMRPLD

SEQ ID NO: 2343 - protein, 352 aa, Chlorella vulgaris
MTIAIGKTQEKRGLFDVVDDWLRRDRFVFVGWSGLLLFPTAYLALGGWFTGTTFVTSWYTHGLATSYLEGCNFLTAAVSTPANSMGHSLLFLWGPEAQGDFTRWCQLGGLWTFVALHGSFALIGFMLRQFEIARSVKIRPYNAIAFSAPISVFVSVFLIYPLGQSGWFFAPSFGVAAIFRFILFFQGFHNWTLNPFHMMGVAGVLGAALLCAIHGATVENTLFEDGDGANTFRAFNPTQAEETYSMVTANRFWSQIFGVAFSNKRWLHFFMLFVPVTGLWMSAIGVVGLALNLRAYDFVSQEIRAAEDPEFETFYTKNILLNEGIRAWMAAQDQPHEKLVFPEEVLPRGNAL

SEQ ID NO: 2344 - protein, 751 aa, Chlorella vulgaris
MTISPPEREAKKVKIVVDRNPVATNFEKWAKPGHFSRTLSKGPTTTTWIWNLHADAHDFDTQTSDLEEISRKVFSAHFGQLGIIFIWLSGMYFHGARFSNYEAWLTDPTHIKPSAQVVWPIVGQEILNADVGGGFQGLQITSGFFQLWRASGITSELQLYTTAIGGLVMAAAMFFAGWFHYHKAAPKLEWFQNVESMLNHHLAGLLGLGSLAWAGHQIHVSLPINKLLDAGVDPKEIPLPHEFLFNPELMAQLYPSFAKGLAPFFTLDWAQYSDFLTFQGGLNPVTGGLWLTDTVHHHLAIAVLFLVAGHQYRTNWGIGSSLKEILEAHKGPFTGEGHKGLYEILTTSWHAQLAINLALFGSLSIIVSHHMYAMPPYPYLATDYGTQLSLFTHHMWIGGFCIVGAGAHAGIFMVRDYDPTNNYNNLLDRVLRHRDAMISHLNWVCIFLGFHSFGLYIHNDTMSALGRPQDMFSDTAIQLQPVFAQWVQNTHFLAPGFTAPNALASTSPSWGGDVVAVGGKVAMMPISLGTADFMVHHIHAFTIHVTVLILLKGVLYARSSRLIPDKANLGFRFPCDGPGRGGTCQVSAWDHVFLGLFWMYNSISIVIFHFSWKMQSDVWGTVSANGVSHITGGNFAQSANTINGWLRDFLWAQSSQVIQSYGSALSAYGLIFLGAHFVWAFSLMFLFSGRGYWQELIESIVWAHNKLKVAPAIQPRALSITQGRAVGVAHYLLGGIATTWSFFLARILAVG

SEQ ID NO: 2345 - protein, 734 aa, Chlorella vulgaris
MATKFPKFSQALAQDPTTRRLWFGIATAHDFESHDGMTEERLYQKIFASHFGQLAIIFLWTSGNLFHVAWQGNFEQWVQDPLHIRPIAHAIWDPHFGQAAVEAFTRGGASGPVNISTSGVYQWWYTIGIRTNQELYVGSIFLLVLAGLFLFAGWLHLQPSFQPALSWFKNAESRLNHHLAGLFGVSSLAWTGHLVHVAIPESRGQHVGWDNFLTVLPHPAGLTPFFTGNWAAYAENPDSLSQLFGTGEGSGTAILTFLGGFHPQTQSLWLTDMAHHHLAIAVVFILAGHMYRTIFGIGHSMREILEAQTPPSGRLGAGHKGLYDTVNNSLHFQLGLALASVGTICSLVAQHMYSLPPYAFLAQDFTTQASLYTHHQYIAGFIMCGAFAHGAIFFVRDYDPEANRGNVLARVLDHKEAIISHLSWVSLFLGFHTLGLYVHNDVVQAFGTPEKQILIEPVFAQWIQAAHGKTVYGFDFLLSSATSAPSLAGQSLWLPGWLQGINSDTNSLFLTIGPGDFLVHHAIALGLHTTTLILVKGALDARGSKLMPDKKDFGYSFPCDGPGRGGTCDISAWDAFYLAVFWMLNTIGWVTFYFHWKHLGIWQGNVNQFNESSTYLMGWLRDYLWLNSSQLINGYNPFGMNSLSVWAWMFLFGHLIYATGFMFLISWRGYWQELIETLAWAHERTPLANLVRWRDKPVALSIVQARLVGLTHFSVGYVLTYAAFLIASTSGKFG

SEQ ID NO: 2346 - protein, 259 aa, Gadus morhua
RNGLMVAEIEELRAALEQTERGRKVAEQELLDASERVGLLHSQNTSLLNSKKKLESDLVQVQGEVDDSVQEARDAEEKAKKAITDAAMMAEELKKEQDTSSHLERMKKNLEVTVKDLQHRLDEAENLAMKGGKKQLQKLEARVRDLESEVDNEQRRGAEAIKGVRKYERRVKELTYQTEEDKKNGCRLQDLVDKLQMKVKAYKRQSEETEEQANSYLSKCRKVQHELEEAEERADIAETQVNKLRAKTRDSGKGKETAE

SEQ ID NO: 2347 - protein, 229 aa, Gadus morhua; identical to SEQ ID NO: 509

SEQ ID NO: 2348 - protein, 258 aa, Gadus morhua
AYVLSSRVRTGRSIKGFTLPPHNSRGERRTIEKLSIEALATLSGEFKGKYYPLNGMTDKEQDQLINDHFLFDKPVSPLLTCAGMARDWPDARGIWHNDAKTFLVWVNEEDHLRVISMQQGGNMKEVFRRFCTGLLKIEETFKKHNHGFMWNEHLGYVLTCPSNLGTGLRGGVHVKLPKLSTHAKFEEILTRLRLQKRGTGGVDTASVGGVFDISNADRLGSSEVDQVQMVVDGVKLMVAMEKKPEKSESIDDMIPAQK

SEQ ID NO: 2349 - protein, 333 aa, Gadus morhua
MVKVGINGFGRIGRLVTRAGFQSKKVEIVAINDPFIDLEYMVYMFKYDSTHGRFHGEVKIEGDKLVIDGHKISVFHERDPANIKWGDAGAQYVVESTGVFTTIEKASAHLKGGAKRVIISAPSADAPMFVMGVNHEKYENSLQVVSNASCTTNCLAPLAKVIHDNFGIVEGLMSTVHAITATQKTVDGPSGKLWRDGRGASQNIIPASTGAAKAVGKVIPELNGKITGMAFRVPTPNVSVVDLTVRLEKPAKYDDIKKVIKAASEGPMKGILGYTEDQVVSTDFNGDIRSSIFDAGAGIALNDHFVKLVTWYDNEFGYSNRVIDLMAHMSCKE

SEQ ID NO: 2350 - protein, 239 aa, Gadus morhua
CVAGDEESYEVFKDLLDPIISDRHSGYKPTDKHRTDLNFENLKGGDDLDPAYVLSSRVRTGRSIKGFTLPPHNSRGERRTIEKLSIEALATLSGEFKGKYYPLNGMTDKEQDQLINDHFLFDKPVSPLLTCAGMARDWPDARGIWHNDAKTFLVWVNEEDHLRVISMQQGGNMKEVFRRFCTGLLKIEETFKKHNHGFMWNEHLGYVLTCPSNLGTGLRGGVHVKLPKLSTHAKFEEIL

SEQ ID NO: 2351 - protein, 218 aa, Gadus morhua
LVIWIYHIFYQMMTNHKPEIIEMTLITTNPYDFPMCSQGQITVASIDDKEELDATDAAIDILGFSHDEKLGIYKFTGAVLHHGNMKFKQKQREEQAEPDGNEEADKIAYLLGLNSADMLKALCYPRVKVGNEYVTKGQTVTQVQNSVSALAKSIYEKMFLWMVIRINEMLDTKQARQYFIGVLDIAGFEIFNFNSMEQLCINFTNGKLQQFFNHHMLI

SEQ ID NO: 2352 - protein, 132 aa, Gadus morhua
LQRIKQKLEKEKSEYKMEIDDLSSNMEAVAKAKGNLEKMCRTLEDQLSEIKAKSDENSRQLNDMNAQRARLQSENGEFSRQLEEKEALVSQLTRGKQAFTQQIEDLKRHVEEEVKAKNALAHAVQSARHDCD

SEQ ID NO: 2353 - protein, 294 aa, Gadus morhua
LMGYVVEIRVKGTAKKDEGWKRCNVAAQLVVCHFTVSSLEKKLEYEFRVSAQNQVGMSLPCNLEGAVMPREILESPDIDLDANLKQGLTVRAGCPIRLCATIRGRPPPTVTWRRMGIDNVVRKGHVDIIDTMTFLVIPDSTRDDSGKYCLTLQNAAGEKAVFVNVKVLDTPGPVVNIEATDIRQTSANLSWSPPEVDGGSEVTHYIIEKRAIDRKTWAVVKGEVEIDKIPFKVGGLTTGTDYYFRVTAVNQYGPGVPKVSSTSYLASDPTSKPDPCEKIEVLEITKNSATVGWV

SEQ ID NO: 2354 - protein, 171 aa, Gadus morhua
MSDKKMTSSRRHHLKSLILSIAAGWLAQEKKDDIAAKEAHMAENCPAPNLSGDQAALSETCKKIAAHLDRLDEERYDAAAKVGKADIEIEDLKMQVVDLAGVKKPALKKVRMSADAMLKALTGLQTHSNMDLRASLKQVKKEVKEEPAEAAGDWRKNIEDKADRKKMFETT

SEQ ID NO: 2355 - protein, 109 aa, Gadus morhua
MAFAGILADADCAAAVKACEAAESFSYKAFFAKCGLSGKSADDIKKAFFVIDQDKSGFIEEDELKLFLQVFKAGARALTDAETKAFLKAGDSDGDGAIGVEEWAVLVKA

SEQ ID NO: 2356 - protein, 237 aa, Gadus morhua
TVSPPSNSSGYIMTKDESITPEIEWYAHQASTLRAGENIKLSCRITGRPIPQVTWYKDGKEIDKRTMIDMEIATNIGSSSLFVRDTDRNHRGIYTVEAKNSSGAKRADVNVRVQDTPGPVEGPIRFTGITAEKCTVWWNPPENDGCAGITHYVVEKRETSRISWATVTSKCEACSFNAANLIKGNEYQFRISAVNKYGVGKPLDSNPIVAQMQYTVPEAPGTPDSTHLTGDSITLCW

SEQ ID NO: 2357 - protein, 461 aa, Gadus morhua
MGKEKTHINIVVIGHVDSGKSTTTGHLIYKCGGIDKRTIEKFEKEAAEMGKGSFKYAWVLDKLKAERERGITIDIALWKFESGKYYVTIIDAPGHRDFIKNMVTGTSQADCAVLIVAGGVGEFEAGISSNGQTREHALLAFTLGVKQLIVGINKMDNTEPPYSQSRYEEITKEVSQYIKKIGYNPAAVPFVPISGWHGDNMLEASSKMAWFKGWKVERKDGNASGTTLLEALDAILPPSRPTDKALRLPLQDVYKIGGIGTVPVGRVETGILKPNMVVTFAPANVTTEVKSVEMHHESLTEALPGDNVGFNVKNVSIKDIRRGNVAGDSKNDPPMQADSFNAQVIILNHPGTISQGYAPVLDCHTAHIACKFNELKEKIDRRSGKKIEDLPKSVKSGDAAIVNMIPSKPMCVESFQSYPPLGRFAVRDMRQTVAVGVIKSVDKKIGGSAKVTKSAKVATKK

SEQ ID NO: 2358 - protein, 141 aa, Gadus morhua
GTRLHQTNTMKFAALALALLLAVGSHAAAMQSDAPSQLAHIRSAVGMYLDQVKDSAARSLDHLDGTEYESYKAQLATSLDSLQASIKTAQAGAEPYTDAAVAQVMEATTEVRASIMADIETLRTGPGPKREALKKVVDGHI

SEQ ID NO: 2359 - protein, 642 aa, Gadus morhua
GIKEADATECILAIKAGEADAITLDGGEIYTAGQHPYDLQPIISEKYGSGSSCYYAVAVVKKDTGFSFKQLRGKKSCHTGIGKTAGWNIPIGTLLTTGQLVWSGQEDLPVESVSTFFSKSCVPGAGGLVGGKLCTLCPSDCSKSATNPYFGYAGAFKCLKDDAGDVAFINHLTVPASEKANYELLCLDGTRAPIDSYKTCNLARVPAHAVVSRVDPELAERIFTALTTVTGFSFFSSAGFGAANLMFKDTTQSLVRLPDGSNSFLYLGAKYMASIQSLKKESDQPITPAIKWCAVGHAEKKKCDSWSSFSVSDGVKSVACQISLTVEGCFQRIMRQEADAMSVDGGQVYTAGKCQLIPAMVEQYNQSLCSSAGTPQATYFAVAVVKKGSGVTWDNLRGKRSCHTGLGRTAGWNIPMGLVHSIHGSCDFGGFFPSGCAPGSEPSSTFCRQCAGSGSGVEDGSKCSASSVEKYYGYAGAFRCLVDGAGDVAFIKHTIVADNSDGQGPAWATALKSSDYQLICPGGVGRAEISDFASCNLAAVPSHAVVTRQDIRDDVVKMLLDQQRKFGIDGSDPLFRIYESKDGNNLLFKDSTKCLKEIPSLTTADAFLGTGYVNAIMSLRQCPETASELEKTCISSSCSTAE

SEQ ID NO: 2360 - protein, 138 aa, Palmaria palmata
MRLTQGAFSFLPDLTDDQISKQVSYAMGKGWSVNIEYTDDPHPRNSYWELWGLPLFDIPDAPTVMYEISSCRKAHPGVYIKVNAFDNTRGVESCSLSFIINRPASEPGFGLLRTEDIGRNQKYAIHSYATEKPEGSRY

SEQ ID NO: 2361 - protein, 177 aa, Palmaria palmata
MLDAFSRVVVNSDAKAAYVGGSDLQALKKFITDGNKRLDSVSFVVSNASCIVSDAVSGMICENPGLIAPGGNCYTNRRMAACLRDGEIILRYASYALLAGDPSVLEDRCLNGLKETYIALGVPTNSSVRAVSIMKASATAFVSGTASDRKMACPDGDCSALASELGSYCDRVAAAIS

SEQ ID NO: 2362 - protein, 164 aa, Palmaria palmata
MKSVMTTTISAADAAGRFPSSSDLESVQGNIQRAAARLEAAEKLASNHEAVVKEGGDACFAKYSYLKNPGEAGDSQEKVNKCYRDVDHYMRLVNYSLVVGGTGPLDEWAIAGAREVYRTLNLPSASYVAAFAFTRDRLCVPRDMSAQAGGEYVAALDYIVNALT

SEQ ID NO: 2363 - protein, 172 aa, Palmaria palmata
MLDAFAKVVAQADARGEFLSNTQLDALSTMVNEGKKRLDVVNKINANASAIVTNSARALFAEQPQLVQPGGNAYTSRRMAACLRDMEIVLRYVSYSMVAGDSSVLDDRCLNGLRETYQALGTPGTSVAVAIQKMKEASVALANDLNNVPLGDCSALTAELGSYFDRAAIAVV

SEQ ID NO: 2364 - protein, 488 aa, Palmaria palmata
MSQSVEQRTRIKNERYESGVIPYAKMGYWDPEHVILETDVLALFRVTPQPGVDPIEASAAIAGESSTATWTVVWTDLLTACDLYRAKCYKVDAVPNTSDQYFAYIAYDIDLFEEGSIANLTASIIGNVFGFKAVKALRLEDMRLPVAYLKTFQGPATGTVVERERMDKFGRPFLGATVKPKLGLSGKNYGRVVYEGLKGGLDFLKDDENINSQPFMRYSERYLYSMEGVNRAQAAAGEIKGHYLNVTAATMENMYERAEFAQQLGSVICMIDLVIGYSAIQSMAIWARKTDMILHLHRAGNSTYSRQKIHGMNFRVICKWMRMAGVDHIHAGTVVGKLEGDPVMIQGFYNTLLESHLEANLPQGIFFEQDWASLRKCTPVASGGIHCGQMHQLLDYLGDDVVLQFGGGTIGHPDGIQAGATANRVALESMVIARNEGRDFVAEGPQILRDAAKTCGPLQTALDLWKDISFNYTSTDTADFVETPTANV

SEQ ID NO: 2365 - protein, 162 aa, Palmaria palmata
MKTPITEAIASADSQGRFLSNAELQSINGRYERASSSLEAAASLTNSAQRLITGAAQAVYTKFPFTTQMPGPTYASSAIGKAKCARDIGYYLRMTTYCLVVGATGPMDEYLVAGLEEINRSFELSPSWYIEALQYIKSSHGLSGQVGNEANTYVDYAINTLS

SEQ ID NO: 2366 - protein, 360 aa, Palmaria palmata
MTATLERRESASLWERFCTWITSTENRLYIGWFGVVMIPTLLTATSVFIIAFVAAPPVDIDGIREPVAGSLLYGNNIISGAIIPSSAAIGIHFYPIWEAASLDEWLYNGGPYQLIVLHFLLGVCCYIGREWELSYRLGMRPWISVAFTAPVAAAAAVFLVYPIGQGSFSDGMPLGISGTFNFMLVFQAEHNILMHPFHQLGVAGVFGGSLFSAMHGSLVTSSLIRETTENESANYGYKFGQEEETYNIVAAHGYFGRLIFQYASFNNSRALHFFLGAWPVVGIWLTSMSVSTMALNLNGFNFNQSVVDSQGRVINTWADILNRANLGMEVMHERNAHNFPLDLASGDSCPVALVAPSING

SEQ ID NO: 2367 - protein, 422 aa, Palmaria palmata
WFKNNESRLNHHLSGLFGLSSLAWTGHLVHVAIPESRGQHVGWDNFTTTLPHPSGLQPFFTGNWSVYANSPDTVNHLFGTDSGAGTAILTFLGGFHPQSQSLWLTDMAHHHLAIAVLFIVAGHMYKTNWGIGHNLKDILEAHRPPSGRLGAGHKGLFETITNSLHMQLGLALASLGVITSLVAQHMYAMPPYAFMAKDFTTQAALYTHHQYIAGFLMVGAFAHGAIFFVRDYDPQQNEGNVLARMLEHKEAIISHLSWVSLFLGFHTLGLYIHNDTVIAFGNPEKQILIEPVFAQWIQASSGKALYGFNVLLSSSSSAATEAGSGVWLPGWLEAINSGKNSLFLTIGPGDFLVHHAIALGLHTTTLILVKGALDARGSKLMPDKKDFGYSFPCDGPGRGGTCDISAWDAFYLSVFWMLNTIG

SEQ ID NO: 2368 - protein, 496 aa, Palmaria palmata
IFSAHFGQLSIIFLWLSGMYFHGARFSNYVAWLNNPTTIKPSAQVVWPIVGQEILNGDVGGGFQGVQVTSGWFQMWRASGITTEYQLYATAIGGLVMSALMIFAGWFHYHKSAPKLEWFQNVESMMNHHLAGLLGLGCLGWAGHQIHISLPINKLLDSGISPQELPLPHEFLLNKELMVQLYPSFSKGILPFFTLDWNAYSDFLTFKGGLNPVTGGLWLTDTAHHHLALAVLFLVAGHMYRTNWGIGHSMKEILEAHKGPFTGEGHKGLYEILTTSWHAQLAINLAMIGSLSIIVAHHMYAMPPYPFIATDYPTQLSLFTHHMWIGGFCIVGAGAHASIFMVRDYNPAQNYNNLLDRVIRHRDAIISHLNWVCIFLGFHSFGLYIHNDTMRALGRSQDMFSDTAIQLQPIFAQWVQNIHTLAPGNTAPNALTTASYAFGGDVVAVGNKVAMMPISLGTADFMVHHIHAFTIHVSVLILVKGFLFARNSRLIPDKSS

SEQ ID NO: 2369 - protein, 189 aa, Actinidia deliciosa
ISSCNGPCRDLNDCDGQLICIKGKCNDDPQVGTHICRGTTHSHQPGGCKPSGTLTCRGKSYPTYDCSPPVTSSTPAKLTNNDFSEGGDDGGPSECDESYHNNNERIVALSTGWYNGGSRCGKMIRITASNGKSVSAKVVDECDSRHGCDKEHAGQPPCRNNIVDGSNAVWSALGLDKNVGVVDITWSMA

SEQ ID NO: 2370 - protein, 225 aa, Actinidia deliciosa
MSTFKSLSLSALLFIAFLFTCARGATFNIINNCPFTVWAAAVPGGGKRLDRGQNWIINPGAGTKGARVWPRTGCNFDGAGRGKCQTGDCNGLLQCQAFGQPPNTLAEYALNQFNNLDFFDISLVDGFNVAMEFSPTSGGCTRGIKCTADINGQCPNELRAPGGCNNPCTVFKTDQYCCNSGNCGLTNFSKFFKDRCPDAYSYPKDDQTSTFTCPAGTNYKVVFCP

SEQ ID NO: 2371 - protein, 380 aa, Actinidia deliciosa
MGLPKSFVSMSLLFFSTLLILSLAFNAKNLTQRTNDEVKAMYESWLIKYGKSYNSLGEWERRFEIFKETLRFIDEHNADTNRSYKVGLNQFADLTDEEFRSTYLGFTSGSNKTKVSNRYEPRVGQVLPSYVDWRSAGAVVDIKSQGECGGCWAFSAIATVEGINKIVTGVLISLSEQELIDCGRTQNTRGCNGGYITDGFQFIINNGGINTEENYPYTAQDGECNLDLQNEKYVTIDTYENVPYNNEWALQTAVTYQPVSVALDAAGDAFKHYSSGIFTGPCGTAIDHAVTIVGYGTEGGIDYWIVKNSWDTTWGEEGYMRILRNVGGAGTCGIATMPSYPVKYNNQNHPKPYSSLINPPAFSMSKDGPVGVDDGQRYSA

SEQ ID NO: 2372 - protein, 116 aa, Actinidia deliciosa
MVPKPLSLLLFLLLALSAAVVGGRKLVAAGGWRPIESLNSAEVQDVAQFAVSEHNKQANDELQYQSVVRGYTQVVAGTNYRLVIAAKDGAVVGNYEAVVWDKPWMHFRNLTSFRKV

SEQ ID NO: 2373 - protein, 150 aa, Actinidia deliciosa
MDLSGKMVKQVEILSDGIVFYEIFRYRLYLISEMSPVNIQGVDLLEGNWGTVGSVIFFKYTIDGKEKTAKDIVEAIDEETKSVTFKIVEGDLMELYKTFIIIVQVDTKGEHNSVTWTFHYEKLKEDVEEPNTLMNFCIEITKDIETYHLK

SEQ ID NO: 2374 - protein, 321 aa, Actinidia deliciosa
TAVTDIVPDVVVAKDGSGNFTTVGAAVAAAKDSSTARFVIYIKEGAYFEYVDVDKKKTNLMFIGDGIGKTWIKGNRSVVDGWTTFRSSTVAVVGTGFIARGISFENYAGPSKHQAVALRSGADFSAFYQCSFVGYQDTLYVHSLRQFYSECDVYGTIDFIFGNAAAVLQKCNLYARKPNENQKNIFTAQGRDDPNQNTGISILNCKVAAAADLIPVLSSFKTYLGRPWKEYSRTVFLLSQMESLIDPAGWLEWSGDFALTTLYYREYKNTGPGSNTTARVTWPGYAVTTNETEVIQFTVGNFIQGSQWLTSYNIPVYLNLT

SEQ ID NO: 2375 - protein, 378 aa, Actinidia deliciosa
MGSPKSIISKSLLFFSTLLILSSAIDIENSVQRTNDQVMAMYESWLVEHGKSYNSLDEKEMRFEIFKENLRIIDDHNADANRSYSLGLNRFADLTDEEYRSTYLGLKRGPKTDVSNQYMPKVGDALPDYVDWRTVGAVVGVKNQGLCSSCWAFSAVAAVEGINKIVTGNLISLSEQELVDCGRTQITKGCNRGLMTDAFKFIINNGGINTENNYPYTAKDGQCNLSLKNQKYVTIDSYKNVPSNNEMALKKAVAYQPVSVGVESEGGKFKLYTSGIFTGSCGTAVDHGVTIVGYGTERGMDYWIVKNSWGTNWGESGYIRIQRNIGGAGKCGIAKMPSYPVKYTSNPLKPYPYVTNPHTLSMSKDNPLGVNDGQRSSA

SEQ ID NO: 2376 - protein, 317 aa, Actinidia deliciosa
MSITLSRPSLSRPSLSRHPSLTLHSSLSHAPPHHRPVAFLRHPTLRYHHHGRLLSVASAILQDTAIRQDTYIWTPVPISRVLPAAAESLFKVIVDLSRSPDLVYNFVSPGQYVQIRIPEAIVNPPPRPAYFYIASPPSLVKKNLEFEFLIRSVPGTTSEVLCSLKEGDVVDLTQIIGRGFDIEQILPPEDYPTVLISVTGYGMSAGRSFIEEGFGANKRSDVRLYYGAENLETMGYQERFKDWEASGVRVIPVLSRPPPNWNGAVGYVQDVYLKDKPIADPRTTGAVLIGNPNMVEETRGILVAQGVSREKILVTQD

SEQ ID NO: 2377 - protein, 479 aa, Chenopodium quinoa
MAKSTTTLFLLSCSIALVLLNGCMGQGRMREMQGNECQIDRLTALEPTHRIQAEGGLTEVWDTQDQQFQCSGVSVIRRTIEPNGLLLPSFTSGPELIYIEQGNGISGLMIPGCPETFESMSQESWREGMERGMRGGRFQDQHQKIRHLRQGHIFAMPAGVAHWAYNSGNEPLVAVILIDTSNHANQLDKDYPKRFYLAGKPQQEHSRHHHRGGESQRGEHGSDGNVFSGLDTKSVAQSFGVSEDIAEKLQAKQDERGNIVLVQEGLHVIKPPSSRSYDDEREQRHRSPRSNGLEETICSARLSENIDDPSKADVYSPEAGRLTTLNSFNLPILSNLRLSAEKGVLYRNAIMAPHYNLNAHSIIYGVRGRGRIQIVNAQGNSVFDDELRQGQLVVVPQNFAVVKQAGEEGFEWIAFKTCENALFQTLAGRTSAIRAMPVEVISNIYQISREQAYRLKFSRSETTLFRPENQGRQRREMAA

SEQ ID NO: 2378 - protein, 480 aa, Chenopodium quinoa
MAKSTTTLFLLSCSIALVLLNGCMGQGRMREMQGNECQIDRLTALEPTNRIQAEGGLTEVWDTQDQQFQCSGVSVIRRTIEPNGLLLPSFTSGPELIYIEQGNGISGLMIPGCPETFESMSQELWREGMERGMRGGRFQDQHQKIRHLRQGHIFAMPAGVAHWAYNTGNEPLVAVILIDTSNHANQLDKDYPKRFYLAGKPQQEHSRHQHRGGESQRGERGSGGNVFSGLGTKTIAQSFGVSEDIAEKLQAEQDERGNIVLVQEGLHVIKPPSSRSYDDEREQRRHRSPRSNGLEETICSARLSENIDEPSKADVYSPEAGRLTTLNSFNLPILSNLRLSAEKGVLYRNAIMAPHYNLNAHSIIYGVRGRGRIQIVNAQGNSVFDDELRQGQLVVVPQNFAVVKQAGEEGFEWIAFKTCENALFQTLAGRTSAIRAMPLEVISNIYQISREQAYRLKFSRSETTLFRPENQGRQRRDLAA

SEQ ID NO: 2379 - protein, 198 aa, Thunnus thynnus
MAPKKDAKAPAKKAEPAKKAEPAPAPAPAPEPAPAPAAPAAVDLSAVKVEFSADQIEDYKEAFGLFDRVGDNKVAYNQIADIMRALGQNPTNKDVAKLLGMPSAEDMTNKRVEFEGFLPMLQTIINSPNKAGYEDYVEGLRVFDKEGNGTVMGAELRIVLSTLGEKMTEAEIDALMQGQEDESGCVNYEAFVKHIMSV

SEQ ID NO: 2380 - protein, 170 aa, Thunnus thynnus
MAPKKAKRRAAAGEGGSSNVFSMFEQSQIQEYKEAFTIIDQNRDGIISKDDLRDVLASMGQLNVKNEELEAMIKEASGPINFTVFLTMFGEKLKGADPEDVILSAFKVLDPDATGTIKKEFLEELLTTQCDRFTPEEIKNMWAAFPPDVAGNVDYKNICYVITHGEEKEE

SEQ ID NO: 2381 - protein, 284 aa, Thunnus thynnus
MDAIKKKMQMLKLDKENALDRAEQAESDKKASEERSKQLEDDLVGLQKKLKGTEDELDKYSEALKDAQEKLELAEKKATDAEGEVASLNRRIQLVEEELDRAQERLATALTKLEEAEKAADESERGMKVIENRAMKDEEKMELQEIQLKEAKHIAEEADRKYEEVARKLVIIEGDLERTEERAELSEGKCSELEEELKTVTNNLKSLEAQAEKYSQKEDKYEEEIKVLTDKLKEAETRAEFAERSVAKLEKTIDDLEDELYAQKLKYKAISEELDHALNDMTSI

SEQ ID NO: 2382 - protein, 270 aa, Thunnus thynnus
  MOD_RES (270)..(270): Any amino acid
LWKFETSKYYVTIIDAPGHRDFIKNMITGTSQADCAVLIVAAGVGEFEAGISKNGQTREHALLAFTLGVKQLIVGVNKMDSTEPPYSQARFEEITKEVSTYIKKIGYNPATVAFVPISGWHGDNMLEGSSKMSWFKGWKIERKEGNASGTTLLEALDAIVPPSRPTDKPLRLPLQDVYKIGGIGTVPVGRVETGLLKPGMVVTFAPPNLTTEVKSVEMHHESLPEAVPGDNVGFNVKNVSVKEIRRGYVAGDSKNDPPKAADSFNAQGHX

SEQ ID NO: 2383 - protein, 145 aa, Odocoileus virginianus; identical to SEQ ID NO: 571

SEQ ID NO: 2384 - protein, 1638 aa, Meleagris gallopavo
MASSDAEMAVFGEAAPYLRKSEKRIEAQNKPFDAKSSVFVAHPKESFVKGTIIQSKESGKVTVKTEGGETLTVKEDQIFSMNPPKYDKIEDMAMMTHLHEPAVLYNLKERYAAWMIYTYSGLFCVTVNPYKWLPVYNPEVVLAYRGKKRQEAPPHIFSISDNAYQFMLTDRENQSILITGESGAGKTVNTKRVIQYFATIAASGDKKKEEQSGKMQGTLEDQIISANPLLEAFGNAKTVRNDNSSRFSKGKFIRIHFGATGKLASADIETYLLEKSRVTFQLKAERSYHIFYQIMSNKKPELIDMLLITTNPYDYHFVSQGEITVPSINDQEELMATDNVLSIVISPRQIFYFTFSVVECHFSCYLVADKAAYLMGLNSADLLKALCYPRVKVGNEYVTKGQTVQQVNNSVGALAKAVYEKMFLWMVVRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYDQHLGKSSNFQKPKASVIKKIESYFSLFVLRRLYCFCLYYGEFRVSLETFSKKVFNLFKNRIKLIFTQIGRTQNNFISLCGSEKLYNSFHWINSTIAENLNKLMTNLRSTHPHFVRCIIPNETKTPGAMEHELVLHQLRCNGVLEGIRICRKGFPSRVLYADFKQRYKVLNASAIPEGQFIDSKKASEKLLSSIDVDHTQYKFGHTKVFFKAGLLGLLEEMRDEKLAQLITRTQARCRGFLMRVEYQRMVERRGVSHLHLKALYFGESPSDHISQNNQMYILIMLQRVHRAKAEKHRADLSRELEEISERLEEAGGATAAQIDMNKKREAEFQKMRRDLEEATLQHEATAAALRKKHADSTAELGEQIDNLQRVKQKLEKEKSELKMEIDDLASNMESVSKAKANLEKMCRTLEDQLSEIKTKEEEHQRMINDLNTQRARLQTEAGEYSRQVEEKDALISQLSRGKQAFTQQIEELKRHLEEEIKAKNALAHALQSARHDCDLLREQYEEEQEAKGELQRALSKANSEVAQWRTKYETDAIQRTEELEEAKKKLAQRLQDAEEHVEAVNAKCASLEKTKQRLQNEVEDLMIDVERANAACAALDKKQKNFDKILAEWKQKYEETQAELEASQKESRSLSTELFKMKNAYEESLDHLETLKRENKNLQQEISDLTEQIAEGGKAIHELEKVKKQIEQEKSEIQAALEEAEASLEHEEGKILRLQLELNQVKSEIDRKIAEKDEEIDQLKRNHLRIVESLQSSLDAEIRSRNEALRLKKKMEGDLNEMEIQLSHANRVAAEAQKNLRNTQTVLKDTQIHLDDALRSQEDLKEQVAMVERRANLLQAEIEELRAALEQTERSRKVAEQELLDASERVQLLHTQNTSLINTKKKLETDIAQIQSEMEDTIQEARNAEEKAKKAITDAAMMAEELKKEQDTSAHLERMKKNLDQTVKDLQHRLDEAEQLALKGGKKQIQKLEARVRELEGEVDAEQKRSAEAVKGVRKYERRVKELDLPVSEEDRKNILRLQDLVDKLQMKVKSYKRQAEEAEELSNVNLSKFRKIQHELEEAEERADIAESQVNKLRVKSREFHSKKIEGEE

SEQ ID NO: 2385 - protein, 1518 aa, Meleagris gallopavo
AVGALAKAVYERMFLWMVLRINQQLDTKQPRQYFIGVLDIAGFEIFDFNSFEQLCINFTNEKLQQFFNHHMFVLEQEEYKKEGIEWTFIDFGMDLAACIELIEKPMGIFSILEEECMFPKATDTSFKNKLYDQHLGKSSNFQKPKPTKGKVEAHFSLIHYAGTVDYNITGFSQDNVFKWNNVIQETFKKYLKKMLRLFFWKHALEIRPLIIDDNNLQKLTQSYLYISPGTYNENLNKLMTNLRSTHPHFVRCIIPNETKTPGAMEHELVLHQLRCNGVLEGIRICRKGFPNRVLYADFKQRYKVLNASAIPEGQFIDSKKACEKLLGSIDIDHTQYKFGHTKVFFKAGLVGLLEEMRDEKLAQLITRTQARCRGFLMRVEYQKMVERRESIFCIQYNIRAFMNVKHWPWMKLFFKIKPLLKSAESEKEMANMKQEFEKTKEELAKSEAKRKELEEKMVKLVQEKNDLQLQVQAEADALADAEERCDQLIKTKIQLEAKVKEVTERAEDEEEINAELTAKKRKLEDECSELKKDIDDLELTLAKVEKEKHATENKVKNLTEEMAALDETIVKLTKEKKALQEAHQQTLDDLQAEEDKVNTLTKAKTKLEQQVDDVRTKAQGYYGTVVEINMAGRALYNQEKCIQKEVLSFSSFPQMQNHTSKGREFQAEGISWRSQLGLPAGHEQEGAAEIRKEGLERLEEEGLRKISPPTDSQVRKYLQKLSRDKSKAAFGLQSAMGNDSLRDGKASRQSPVRNWRTVLQKVEAHSAVAIRSLHVFTLTENVGEPVDSSAKETKKINPFEMETRPVATFHVTATVQEVMFRAAQTKQATRLMLLLQNAEIMKKGLNEVTSRKLEMARQNTVYSEDLSENGDMASSSCRPLPCQGQVLTWLPHTWAEEFACKHDLICSASSKRTTREYAIKNPNKITIKKTKSNKTKTKQNKKPPQQPYQFLLSSDLVQRIVPMQQGNSDRRMKLASSSEVIQGICLKATMQKKTAQERQNTLDKLFIDIFTYSLPDNALPKKFCQKCFDRRKGEHLQLLQTRHYKISQGQVWPVSTEGFKTLCCIKKQLPFLFHRIDHFPLQKKDLKKEISDLTEQIAEGGKAIHELEKVKKHVEQEKSELQASLEEAEASLEHEEGKILRLQLELNQIKSEIDRKIAEKDEEIDQLKRNHLRIVESMQSTLDSEIRSRNEALRLKKKMEGDLNEMEIQLSHANRMAAEAQKNLRNTQGTLKDTQIHLDDALRTQEDLKEQVAMVERRANLLQAEVEELRAALEQTERSRKVAEQELLDATERVQLLHTQNTSLINTKKKLETDIVQIHSEMEDTIQEARNAEEKAKKAITDAAMMAEELKKEQDTSAHLERMKKNLDQTVKDLQHRLDEAEQLALKGGKKQIQKLEARVRRCGAGREVDAEQKRSAEAVKGVRKYERRVKELTYQTEEDRKNILRLQDLVDKLQMKVKSYKRQAEEAEELSNVNLSKFRKIQHELEEAEERADIAESQVNKLRAKSREFHGKKIEEE

SEQ ID NO: 2386 - protein, 819 aa, Meleagris gallopavo
DAEMAVFGEAAPYLRKSEKRIEAQNKPFDAKSSVFVAHPKESFVKGTIQSKESGKVTVKTEGGETLTVKEDQIFSMNPPKYDKIEDMAMMTHLHEPAVLYNLKERYAAWMIYTYSGLFCVTVNPYKWLPVYNPEVVLAYRGKKRQEAPPHIFSISDNAYQFMLTDRENQSILITGESGAGKTVNTKRVIQYFATIAASGDKKKEEQSGKMQGTLEDQIISANPLLEAFGNAKTVRNDNSSRFGKFIRIHFGATGKLASADIETYLLEKSRVTFQLKAERSYHIFYQIMSNKKPELIDMLLITTNPYDYHYVSQGEISVPSIDDQEELMATDSAIDILGFTADEKTAIYKLTGAVMHYGNLKFKQKQREEQAEPDGTEVADKAAYLMGLNSAELLKALCYPRVKVGNEFVTKGQTVSQVHNSVGALAKAVYEKMFLWMVIRINQQLDTKQPRQYFIGVLDIAGFEIFDFNSFEQLCINFTNEKLQQFFNHHMFVLEQEEYKKEGIEWEFIDFGMDLAACIELIEKPMGIFSILEEECMFPKATDTSFKNKLYDQHLGKSNNFQKPKPAKGKAEAHFSLHYAGTVDYNISGWLEKNKDPLNETVIGLYQKSSVKTLALLFATYGGEAEGGGKKGGKKKGSSFQTVSALFRENLNKLMANLRSTHPHFVRCIIPNETKTPGAMEHELVLHQLRCNGVLEGIRICRKGFPSRVLYADFKQRYRVLNASAIPEGQFMDSKKASEKLLGSIDVDHTQYRFGHTKVFFKAGLLGLLEEMRDDKLAEIITRTQARCRGFLMRVEYRRMVERRESIFCIQYNVRSFMN

SEQ ID NO: 2387 - protein, 452 aa, Meleagris gallopavo
MKNAYEESLDHLETLKRENKNLQQEISDLTEQIAEGGKAIHELEKVKKQIEQEKSEIQAALEEAEASLEHEEGKILRLQLELNQVKSEIDRKIAEKDEEIDQLKRNHLRIVESLQSSLDAEIRSRNEALRLKKKMEGDLNEMEIQLSHANRVAAEAQKNLRNTQTVLKDTQIHLDDALRSQEDLKEQVAMVERRANLLQAEIEELRAALEQTERSRKVAEQELLDASERVQLLHTQNTSLINTKKKLETDIAQIQSEMEDTIQEARNAEEKAKKAITDAAMMAEELKKEQDTSAHLERMKKNLDQTVKDLQHRLDEAEQLALKGGKKQIQKLEARVRELEGEVDAEQKRSAEAVKGVRKYERRVKELTYQSEEDRKNILRLQDLVDKLQMKVKSYKRQAEEAEELSNVNLSKFRKIQHELEEAEERADIAESQVNKLRAKSREFHRRIEEEE

SEQ ID NO: 2388 - protein, 1729 aa, Meleagris gallopavo
GTLEDQIISANPLLEAFGNAKTVRNDNSSRFGKFIRIHFGTTGKLASADIETYLLEKSRVTFQLASERSYHIFYQIMSNKKPELIDLLLITTNPYDFTYVSQGEITVASIDDSEELLATDNAVDILGFSPDEKVGMYKLTGAVMHYGNMKFKQKQREEQAEPDGTEVADKAAYLMGLNSAELLKALCYPRVKVGNEYVTKGQNVQQVYNSVGALAKSVYEKMFLWMVTRINQQLDTKQPRQHFIGVLDIAGFEIFDFNSLEQLCINFTNEKLQQFFNHHMFVLEQEEYKKEGIDWEFIDFGMDLAACIELIEKPMGIFSILEEECMFPKATDTSFKNKLYDQHLGKSNNFQAPGPGGQAADEDHFSELSYNNTDSHLALNALNKNKQPLRNETVVGLYQKSSLKLLSFLFSNYAGAETSDSGSGKKGGKKKGGSFQTVSAVFRENLNKLMTNLRSTHPHFVRCLIPNETKTPGEMDHYLVMHQLRCNGVLEGIRICRKGFPSRILYADFKQRYKILNASAIPEGQFIDKKKIGKKLFGKVDINAALYCYCHTKVFFKAGLLGLLEEMRDEKLVSLITHMQAMCRGYLMRTEFKKMNARREDMLCETGTVKAALNKILWHSIKIQSNLKSALKTPDTAVRNSKLEGDLKLAHDSIMDLENDKQQLDEKLKNQIQSKIDLHLQVQSESENLADAEERCEGLIKSKIQLEARIKELNERMEDEEEMNAELTAKKRKLEDECSELKKDIDDLELTLAKVEKEKHATENKVKNLTEEMAALDENISKLTKEKKALQEAHQQTLEYLQAEEDKVSILTKIKTKLEQQVDDLEGSLEQERKQRMDLERAKRKLDGDLKMSQDSIMDLKNDKQQTDERLKKKDFEISHLQSKIEDEQAQSSQLQKKIKELQARTEELEEEIEAERANCAKTEKQRADLSRELEEISERLEEAGGATAAQIEMNKKREAEFQKMRRDLEEATLQHEATAAALRKKHADSTAELGEQIDNLQRVKQKLEKEKSELKMGPSVSPASFETLMSVSKAKSNLEKMCRALEDQYSEVRTKDDEHMRLINDMNTQKTRLQTENGELTRQLEEKESLISQLTRGKQAITQQTEELKRQLEEENKAKNALAHGLQSARHDCDLLREQYEEELEAKGELQRALSKANSEVAQWRTKYETDAIQCMEELEDAKKKLAQRLQDSEEQIEAVNSKCASLEKTKQRLQGEVDDLMIAVERSNAACAAFDKKQKNFDKVMAEWKQKYQESQAELEAAQKESRTLSTEIFRMKNAYEEVLDQVETVRRENKNLQQEISDLTEQLAEAGKANHGLEKAKKQTEQEKYDLQAALEEAEVSLEHEEGKILRVQLELNQVKSGVDRRSAEKDEEIQQLKKNHQRVLESMQTMLDAEIRSRNDALRLKKKMEGDLNDMEIQLSRANCQIAEIQKHLKGMQGQLKDSQLHLDDALRENDDLKEQLAVVERRNNLMMTELEQMRAALEQTERARKVSEQELTDTSERVQILHSQNTSLLNTKKKLEVDITHLQNEVEDSIQEASNAEEKAKKAITDAAMMAEELKKEQDTSAHLERMKRNLEQMVKDLQHRLDEAEQLTLKGGKKQLQKLEARIHELENELDIEQKRGTESLKGARKYERRLKELTYQSEEDKKNILRLQNLVDKLQLKVKAYKKQAEEAEEQASTNLSRCRKTQHELEEAEERADIAECQVNKLRAKSRDTGRQVSWSA

SEQ ID NO: 2389 - protein, 377 aa, Meleagris gallopavo
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 2390 - protein, 1946 aa, Meleagris gallopavo
MMDMTEFGEAAPFLRKSEKELMMLQTVAFDGIREKKCWVPDEKKAYVEAEITESSGGKVTVETTDGRTMTIKEDDVQSMNPPKFDMIEDMAMLTHLNEASVLYNLRKRYSNWMIYTYSGLFCVTINPYKWLPVYKSEVVAAYKGKRRSEAPPHIFSIADNAYHDMLRTTDRENQSMLITGESGAGKTVNTKRVIQYFATVAALGEPGKKSQPATKTGGTLEDQIIQANPALEAFGNAKTLRNDNSSRFGKFIRIHFGTTGKLSSADIEIYLLEKSRVIFQQPGERDYHIFYQILSGKKPELLDMLLVSTNPYDYHFCSQGVVTVDNLDDGEELMATDQAMDILGFVQDEKSGAYKLTGAIMHFGNMKFKQRPREEQAEADGTESADKAAYLMGINSSDLVKGLLHPRVKVGNEYVTKGQSVEQVLYAVGALSKAVYDRMFKWLVVRINKTLDTKLPRQFFIGVLDIAGFEIFDFNSFEQLCINYTNEKLQQFFNHHMFVLEQEEYKKEGIEWIFIDFGMDLQACIDLIEKPLGILSILEEECMFPKATDMTFKAKLYDNHLGKSPNFQKPRPDKKRKYEAHFELIHYAGSVPYNIIGWLEKNKDPLNETVVGIFQKSSNKLLASLFESYVGADSADQGGEKKRKKGASFQTVSSLHKENLNKLMTNLRSTAPHFVRCIIPNESKTPGAMDAFLVLHQLRCNGVLEGIRICRKGFPNRVLYADFKQRYRILNPGAIPEDKFVDSRKAAEKLLASLDIDHNQYRFGHTKVFFKAGLLGHLEEMRDERLAKILTMIQARARGRLMRIEFQKIVERRDALLVIQWNIRAFMAVKNWPWMKLFFKIKPLLKSAETEKEMANMKEEFLKLKEALEKSEARRKELEEKQVSLVQEKNDLLLQLQAAPQEQDTLADAEERCDLLIKSKIQLEAKVKELTERVEDEEEMNSELTSKKRKLEDECSELKKDIDDLEITLAKVEKEKHATENKVKNLTEEMAALDENISKLTKEKKSLQEAHQQVLDDLQAEEDKVNTLSKAKVKLEQQVDDLEGSLEQEKKVRMDLERAKRKLEGDLKLTQESVMDLENDKLQMEEKLKKKEFEMSQLNSKIEDEQAIVMQLQKKIKELQARIEELEEELEAERAARAKVEKQRSDLARELEELSERLEEAGGATAAQLEMNKKREAEFLKLRRDLEEATLHYEATAAALRKKHADSVAEMGEQLDNLQRVKQKLEKEKSELKMEVDDLTSNMEQTVKGKANAEKLCRTYEDHLNETKSKLDEMTRLMNDLTTQKAKLQSENGEFVRQLEEKESLISQLSRGKTSFTQQIEELRRQLEEETKSKNALAHALQAARHDCDLLREQYEEEQEAKAELQRALSKGNAEVAQWRTKYETDAIQRTEELEDAKKKLAARLQEAEEAIEAANAKCSSLEKTKHRLQNELEDMMIDLEKANSAAASLDKKQRGFDKIINDWKQKYEESQAELEASQKEARSLSTELFKLKNAYEETLDHLETLKRENKNLQEEISDLTNQISEGNKNLHEIEKVKKQVEQEKSEVQLALEEAEGALEHEESKTLRFQLELSQLKADFERKLAEKDEEMENIRIRRNQQRTIDSLQSTLDSEARSRNEAIRLKKKMEGDLNEMEIQLSHANRHAAEATKSARGLQTQIKELQVQLDDLGHLNEDLKEQLAVSDRRNNLLQSELDELRALLDQTERARKLAEHELLEATERVNLLHTQNTSLINQKKKLEGDISQMQNEVEESIQECRNAEEKAKKAITDAAMMAEELKKEQDTSAHLERMKKNMEQTIKDLQKRLDEAEQIALKGGKKQIQKLESRVRELENELENELRRNSDAQKGARKFERRIKELTYQSEEDKKNLARMQDLIDKLQLKVKSYKHQAEEAEAQANLYLSKYRKQQHDLDDAEERAEIAESQVNKLRSKSRDIGMKKVHEEE

SEQ ID NO: 2391 - protein, 1874 aa, Meleagris gallopavo
TLTVPEANVHPQNPPKFDRIEDMAMLTFLHEPAVLYNLKERYASWMIYTYSGLFCVTVNPYKWLPVYNAEVVAAYRGKKRTEVPPHIFSISDNAYQNMLTDRENQSILITGESGAGKTVNTKRVIQYFASIAAIGDRKKEVANSSKQGTLEDQIIQANPALEAFGNAKTVRNDNSSRFGKFIRIHFGATGKLASADIETYLLEKSRVIFQLKAERNYHIFYQILSNKKPELLEMLLITNNPYDYSYVSQGEVTVASIDDSEELLATDSAFDVLGFTAEEKAGVYKLTGAIMHFGNMKFKQKQREEQAEPDGTEDADKSAYLMGLNSADLLKGLCHPRVKVGNEYVTKGQSVQQVYYSIGALAKAVYEKMFNWMVVRINNSLETKQPRQYFIGVLDIAGFEIFDFNSFEQLCINFTNEKLQQFFNHHMFVLEQEEYKKEGIEWEFIDFGMDLQACIDLIEKPMGIMSILEEECMFPKASDMTFKAKLFDNHLGKSANFGKPRNVKGKAEAHFSLIHYAGTVDYNIIGWLEKNKDPLNETVVGLYQKSALKLLASLFSNYAGADTGKSGDSGKGKGAKKKGSSFQTVSALHRENLNKLMANLKTTHPHFVRCLIPNERKEPGVMDNPLVMHQLRCNGVLEGIRICRKGFPNRILYGDFRQRYRILNPTAIPEGQFIDSRKGAEKLLGSLDIDHNQYKFGHTKVFFKAGLLGLLEEMRDERLSLIITRIQAQARGQLMRIEFKKILERRDALLVIQWNIRAFMGVKNWPWMKLYFKIKPLLKSAETEKEMQTMKEEFGHLKEALEKSEARRKELEEKMVSMLQEKNDLQLQVQAEQDNLADAEERCDQLIKNKIQLEAKVKEMTERLEEEEEMNAELTAKKRKLEDECSELKKDIDDLELSLAKVEKEKHATENKVKNLTEEMAGLDENITKLTKEKKTLQESHQQALDDLQAEEDKVNTLAKAKVKLEQQVDDLESSLEQEKKIRMDLERAKRKLEGDLKLAQESVMDLENDKQQLEERLKKKDFELNTLNARIEDEQAIAAQLQKKLKELQARIEELEEELEAERMGRAKVEKLRSELLQELEETSERLEEAGGATSVQLELNKKREAEFQKLRRDLEEATLQHEATAAALRKKHADSVAELSEQLDNLQRVKQKLEKEKSELKLELDDVSSNTEQLIKAKANLEKMCRTMEDQMNEHRSKLEEAQRTVTDLSTQRAKLQTENSELSRQLEEKEAFINQLMRGKLTYTQQLEDLKRQLEEEAKAKNALAHALQSAQHDCDLLREQYEEEMEAKAELQRALSKANSEVAQWRTKYETDAIQRTEELEEAKKKLAQRLQEAEEAVEAVNAKCSSLEKTKHRLQNEIEDLMADVERSNAAAAALDKKQRNFDKILSEWKQKFEESQTELEASQKEARSLSTELFKLKNAYEESLEHLETFKRENKNLQEEISDLTEQLGASQKSIHELEKVRKQLDAEKLELQAALEEAEASLEHEEGKILRAQLEFNQVKADYERKLAEKDEEMEQAKRNHLRVVDSLQTSLDAETRSRNEALRLKKKMEGDLNEMEIQLSHANRTAAEAQKQVKALQGYLKDTQLQLDDAVRANEDLKENIAIVERRNNLLQSELEELRAMVEQSERARKLAEQELIEASERVQLLHSQNTSLINQKKKMEADISQLQTEVEEAIQECRNAEEKAKKAITDAAMMAEELKKEQDTSAHLERMKKNMEQTVKDLQLRLDEAEQLALKGGKKQLQKLEVRVRELENELEAEQKRNAESIKGLRKSERRVKELSYQTEEDRKNMVRLQDLVDKLQLKVKAYKRQAEEAEEQANSNLAKFRKVQHELDEAEERADMAESQVNKLRARSRDIGAKKGLNEE

SEQ ID NO: 2392 - protein, 1941 aa, Meleagris gallopavo
MLDMSEFGEAAEYLRKSYTEQLKLQTIPFDGKKRAWIPDEKEAYIEVEIKESTGGKVTVETKDKQTRVVKEDELQAMNPPKFDMIEDMAMLTHLNEASVLYNLKRRYSHWMIYTYSGLFCVTINPYKWLPVYTAPVVAAYKGKRRSEAPPHIYSIADNAYTTCCADRENQSMLITLSGESGAGKTVNTKRVIQYFAIVAALGDTPGKKLASVATKTGGTLEDQIIEANPAMEAFGNAKTIRNDNSSRFGKFIRIHFGPSGKLASADIDIYLLEKSRVIFQQPKERSYHIYYQILSGKKPELQDMLLLSLNPYDYHFCSQGVTTVDNLDDGEELMATDHAMDILGFSNDEKYGSYKIVGAIMHFGNMKFKQKQREEQAEADGTESADKAAYLMGISSADLIKGLLHPRVKVGNEYVTKGQNVEQVVYAVGALAKATYDRMFKWLVTRINKTLDTKLARQFFIGVLDIAGFEIFEFNSFEQLCINFTNEKLQQFFNHHMFVLEQEEYKKEGIEWVFIDFGLDLQACIDLIEKPLGILSILEEECMFPKASDMSFKAKLYDNHIGKSPNFQKPRPDKKRKYEAHFELVHYAGVVPYNIIGWLDKNKDPLNETVVAVFQKSQNKLLASLYENYVGSSSEEPHKPGSKEKRKKAASFQTVSQLHKENLNKLMTNLRSTQPHFVRCIIPNETKTPGAMDAFLVLHQLRCNGVLEGIRICRKGFPNRILYADFKQRYRILNPAAIPDDKFMDSRKATEKLLSSLDLDHSQYKFGHTKVFFKAGLLGLLEEMRDERLAKILTMLQARIRGHLMRIEYQKIISRREALYTIQWNIRAFNAVKNWSWMKLFFKIKPLLKSAQTEKEMSTLKEEFQKLKEALEKSEAKRKELEEKQVSMIQEKNDLALQLQAEQDNLADAEERCDLLIKSKIQLEAKVKELTERVEDEEEMNADLTAKKRKLEDECAELKKDIDDLEITLAKVEKEKHATENKVKNLIEEMAALDEIIAKLTKEKKALQEAHQQALDDLQAEEDKVNTLTKAKVKLEQQVDDLESSLEQEKKIRMDLERAKRKLEGDLKLTQESVMDLENDKQQLEEKLKKKDFEMSQLNSRIEDQQVTEAQLQKKIKELQARIEELEEELEAERAARAKVEKQRAEVSRELEELSERLEEAGGATSAQLEMNKKREVEFLKLRRDLEEATLQHESTAAALRKKHADSVAELSEQIDNLQRVKQKLEKEKSEMKMEVDDLSSNIEYLTKNKANAEKLCRTYEDQLSEAKSKVDELQRQLTDVSTQRGRLQTENGELSRLLEEKESFINQLSRGKTSFTQTIEELKRQLEEETKSKNALAHALQASRHDCDLLREQYEEEVEAKSELQRNLSKANAEVAQWRTKYETDAIQRTEELEEAKKKLAIRLQEAEEAVEAAHAKCSSLEKTKHRLQTEIEDLSVDLERANSACAALDKKQRNFDRILAEWKQKYEETQAELEASQKESRSLSTELFKLKNAYEESLDNLETLKRENKNLQEEIADLTDQISMSGKTIHELEKLKKALENEKSDIQAALEEAEGALEHEESKTLRIQLELNQIKADVDRKLAEKDEEFENLRRNHQRAMDSMQATLDAEARAKNEAVRLRKKMEGDLNEMEIQLSHANRQAAEFQKLGRQLQAQIKDLQIELDDTQRQNDDLKEQAAALERRNNLLLAEVEELRAALEQAERSRKLAEQELLEATERVNLLHSQNTGLINQKKKLETDISQLSSEVEDAVQECRNAEEKAKKAITDAAMMAEELKKEQDTSAHLERMKKNMEQTIKDLQMRLDEAEQIALKGGKKQIQKLEARVRELEGELDMEQKKMAEAQKGIRKYERRIKELSYQTEEDRKNLTRMQDLIDKLQSKVKSYKRQFEEAEQQANSNLVKYRKVQHELDDAEERADIAETQVNKLRARTKEVITFKHE

SEQ ID NO: 2393 - protein, 666 aa, Meleagris gallopavo
SGESGAGKTVNTKRVIQYFATIAASGDKKKEEQPAGKMQGTLEDQIISANPLLEAFGNAKTVRNDNSSRFGKFIRIHFGATGKLASADIETYLLEKSRYFHETSYFHTLNMLYFLFSLRKLRSMKMLMLNSISLNLNSISAVGIIFSSVFSSLEYSVFNLSSPVVTDRNCTHLLLIFTYINVSKLFFSFNKIQNNSSVKKNSDIADKAAYLMGLNSADLLKALCYPRVKVGNEFVTKGQTVQQVYNSVGALAKAVFEKMFLWMVVRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYDQHLGKSNNFQKPKPGKGKAEAHFSLVHYAGTVDYNISGWLDKNKDPLNETVVGLYQKSSLKTLALLFASAGGEAESGGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLSSIDVDHTQYKFGHTKVFFKAGLLGLLEEMRDEKLAQLITRTQARCRGFLMRVEYQRMVERRESIFCIQYNVRSFMNVKHWSWMKLFFKIKPLLK

SEQ ID NO: 2394 - protein, 333 aa, Meleagris gallopavo; identical to SEQ ID NO: 1653

SEQ ID NO: 2395 - protein, 399 aa, Meleagris gallopavo
  MOD_RES (1)..(1): Any amino acid
XELQAALEEAEASLEHEEGKILRVQLELNQVKSEIDRKIAEKDEEIDQLKRNHLRIVESMQSSLDAEIRSRNEALRLKKKMEGDLNEIEIQLSHANRQAAEALKNLRNTQGVLKDTQIHLDDALRSQEDLKEQVAMVERRANLLQAETEELRAALEQTERSRKVAEQELLDASERVQLLHTQNTSLINTKKKLESDISQIQSEMEDTIQEARNAEEKAKKAITDSTMISFCDLKLAHDSIMDLENDKQQLDEKLKNYRRRSRSCRQLALKGGKKQIQKLEARVRELEGEVDAEQKRSAEAVKGVRKYERRVKELTYQSEEDRKNVLRLQDLVDKLQMKVKSYKRQAEEAEELSNVNLSKFRKIQHELEEAEERADIAESQVNKLRAKSREIGKKAESEE

SEQ ID NO: 2396 - protein, 530 aa, Meleagris gallopavo
MSKHHDAGTAFIQTQQLHAAMADTFLEHMCRLDIDSEPTIARNTGIICTIGPASRAVDKLKEMIKSGMNVARLNFSHGTHEYHEGTIKNVREATESFASDPITYRPVAIALDTKGPEIRTGLIKGSGTAEVELKKGAALKVTLDNAFMENCDEHVLWVDYKNLIKVIDVGSKIYVDDGLISLLVKEKGKDFVMTEVENGGMLGSKKGVNLPGAAVDLPAVSEKDIQDLKFGVEQNVDMVFASFIRKAADVHAVRKVLGEKGKHIKIISKIENHEGVRRFDEIMEASDGIMVARGDLGIEIPAEKVFLAQKMMIGRCNRAGKPIICATQMLESMIKKPRPTRAEGSDVANAVLDGADCIMLSGETAKGDYPLEAVRMQHAIAREAEAAMFHRQQFEEILRHSVHHRDPADAMAAGAVEASFKCLAAALIVMTESGRSAHLVSRYRPRAPIIAVTRNDQTARQAHLYRGVFPVLCKQPAHDAWAEDVDLRVNLGMNVGKARGFFKTGDLVIVLTGWRPGSGYTNTMRVVPVP

SEQ ID NO: 2397 - protein, 894 aa, Meleagris gallopavo
  MOD_RES (6)..(6): Any amino acid
RNSIHXNMQYTYNYEEDEYMTQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHLSWKDGLGLCALIHRHRPDLIDYSKLNKDDPIGNINLAMEIAEKHLDIPKMLDAEDIVNTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHEQWAYGKEQILLQKDYESASLTEVRAMLRKHEAFESDLAAHQDRVEQIAAIAQELNELDYHDAASVNDRCQKICDQWDSLGTLTQKRREALERTEKLLETIDQLHLEFAKRAAPFNNWMEGAMEDLQDMFIVHSIEEIQSLISAHDQFKATLPEADGERQAILSIQNEVEKVIQSYSMRISASNPYSTVTVEEIRTKWEKVKQLVPQRDQSLQEELARQHANERLRRQFAAQANVIGPWIQTKMEEIARSSIEMTGPLEDQMNQLKQYEQNIINYKHNIDKLEGDHQLIQEALVFDNKHTNYTMEHIRVGWELLLTTIARTINEVETQILTRDAKGITQEQMNDFRASFNHFDRRKNGLMDHDDFRACLISMGYDLGEAEFARIMSLVDPNGQGTVTFQSFIDFMTRETADTDTAEQVIASFRILASDKPYILADELRRELPPEQAQYCIKRMPQYTGPGSVPGALDYTSFSSALYGESDL

SEQ ID NO: 2398 - protein, 3500 aa, Meleagris gallopavo
MYGITDFRGLLQAFELLKQTREEESHRLEIELTEKAQKEDQEFEELVAFIQQRLTQTEPITLIRDIENQTVLTDEDAIFECEIKINYPEIKLSWYKGTQKLDSSDKYEIKIEGDRHILKIRNCQLEDQGNYRIVCGPHIASARLTVIEPAVERHLHDTTFKEGNTCTLSCQFSIPNAKSQWYRNGRPIKIGGRYSTQVSDKVHKLIIKDVRTEDQGQYTCKLDNLETSADLAIEAEPIQFTKSIQNIVVSEHQSATFECEVSFDDAVVTWYKGPTELRESPKYSFRSEGRCHYMTIHNVTAEDEGVYSVIARLEPRGEARSTAELYLVTKEIKLELKPPDVPDAKVAVPPQKPAEAAPIPILLPLIPPPEEKKPAEKKVPVKKVSKKVVKKGAKEIPPPEVPEILPEKPKEVKITSMARREGIHEEKMEIYEKPKEVYEEWEEDYGEDHDYYFKEEGYDEEEEEWEETYEKREVAYEEKQIIHEEAVEVPKKPVPERKPPAIIAEKKEKKEVTVHKVPDVPKKIPEEKVPITVPKKPEPTPAKEPEVPKKIEEKIKVIEPKKPEVPPAKVPEVPKKVVQEEVSVEVPKKPEPPPAKVPEVPKKVVPEEKVHVEVPKKPEPPPPKVLRKKPEEEEPKPEKEPKPEVKPVPTPVEKIKKPEVSEVPKKKPEIPVIKKEEKHVPEPPKEPKQAAISVPGPEPKPAVALKSPKPAAEPAPAITTAPVTTPVVGKKAEAKPTKEETPKGISPVKAKKTPSPADAERRKLRPGSGGEKPPEEPPFTYQLKAVPLKFVKEMKDIVLKEAESVGSSAIFEVLISPSTAITSWMKDGSNIRESPKHKFIADGKDRKLHIIDVQLSDAGEYTCVLRLGNKEKTSTAKLIVEELPVRFVKTLEEEVTVVKGQPLYLTCELNKERSVVWRRDGKIIKDKPGKFALGIIGLSHSLTITDSDDSDAGTYTVTVEDSELSCSSCVKVVEVIRDWLVKPIRDQHVKPKGTATFTCDIVKDTPNIKWFKGDEEIPAEPTDKTEILKEGNKIFLKIKNAGPADIGEYSVEIEGRRYPAKLTLGEREVELLKPLEDVTVYEKETANFDTEISEEDIPGEWKLKGEILRPSPTCEIKAEGGKRFLTLHKVKLEQAGEVLYQALNAVTTAILTVKEIELDFAVPLKDVTVPEKRQARFECVLTREANVIWSKGTDILKIGEKFDIIADGKKHILVINDSQFDDEGEYTAEVEGKKSTARLFVEGKLKFISPLQDQTVKEGETAHFQFELSHEDMLVKWYKNDKRLHTSRTVFITSEGKVHKLEMREVTLDDISEIKAVVKDMNTQANLKVLEADPYFTVRLQDYSALEKDDVTLQCELSKDVPVKWYKDGEELVASSRISIKTDGLRRILTIKKAAEGDKGVYECSCGTDKTNCNIGIEPRLIKVERPLYGVEVFVGETARFEIEISEPDVHPIWKLKGETLTPSPECEILEDGKKHVLILHNCRLDMTGEVSFQAANAKSAANLKVKELPLIFITPLSDVKVFEKDEAKFECEVSREPKTFRWLKGTQEITSDERFEIISDGTKHALIIKSVAFDDEAKYMFEAEDKRTSAKLIIEGIRLKFITPLKDVTKKERETAVFTVELSHENIPVVWFKNDQRLHTTKVVSMTDDGKFHTLTIKDLTIDDTSQIRVEAMGKSSEAKLTVLEGDPYFTGKLQDYTAVEKDEVILQCEISKADAPVKWMKDGKPITPSKNVVIKADGKKRILILKKALKKDIGQYTCDCGTDQTSANLNIEDRDIEIIRPLYSVEVIETETARFDIEISEEGVHGNWKLKGEPLTESPDCEIKEEGKKHFLTLYNVRLDQAGGVDFQAANAKSGAHLRVKPRVIGLLRPLKDVTVTAGESATFDCELSYEGIPVEWYLQGKKLEPSDKVGRLNFIFPYVSRDTKVTALLRPDVIRSFLPKICLLSEPPVEFTKPLEDQTVEEEATAILECEVSRENAKVKWFKNGEEVHKTKKYDIISEGRVRKLVIHGCTLDDAKTYTCDAKDFKTSCFLNVEPLRVEFLRPLTDLEVKEKESARLNVKFLAQVKVKWFKDGIEIRKGKKYDIISKGAERILVISKCLFDDEAEYACEAKTARTSGLLTVIEEEAVFTKNLHDLEVNENETVRLICEISKPNAEVTWFKGDEEVPDGGRFEYISDGRKRILVIRNKKKTDAGKYTCKLPSSSTTGKLTVHELAAEFLTRPQNLEVLEGDKAEFACSVSKEAITVQWLGVLEPSDKYDIISDGKKRTLVVKDSVIGDAGKYSVMVGEAKATARLTVIEKLRIVTPLKDQEVNEGQEIIFNCEVNKEGAKEKWYKNGEAIFDSAKYIIVQKDLVYTLRIRDTQLKDQATYSISLSNHRGEHAESSAALTVLEEDLRIVEPLEDIETMEKKTVTFWCKVNRLNATLKWTKNGEEITFDKRILYKIDKYKHSLIIKDCGFKDEGEYTVTAGQDKSVAELLITEAPADFIEHLQDQTVTEFDDAVFTCQLSKEKASVKWYRNGREIKEGKKYQFEKDGNLHRLIIKDCRLDDECEYSCGVDDRKSRARLFVEEIPVEIIRPPQDVYEAPGADVIFMAELNKDGVEVKWLRNNMIIIQGDKHQMMSEGKVHRLQVCEIKPRDQGEYRFIAKDKEARAKLELAAAPRIKTGDQNLVVDVGKPLTMTVPYDAYPRAEAEWLKGEESLPTTTVDTTNDCTTFKIYEAKKSDKGRYKVVLRNKHGQAEAFINVEVIDVPGPVRNLEVTETYDGEVGLAWQEPESDGGSKIIGYVVERRDIKRKTWIVATDHAENCEYTVTGLQKGGVEYLFRVSARNRVGTGEPIETERPVEAKSKFDVPGPPQNVEVTDVNRFGATLTWEVPEYDGGSPITGYVIELRNRASIKWEPTMTTGADELSAVLTDVVENEEYFFRVRAQNIVGVGKPSHPTRAVKIMDPVERPSPPINLDHSDQTKTSVQLTWEPPLQDGGSPILGYIIERKEEGTDKWIRCNPKLVPALTFKVTGLKAGSSYYYRVSAENAAGVSDPAEAIGPLTADDPFVGPTMDLSAFKDGLEVIVPEPIKIRVPITGYPIPTATWSFGDRVLEEGDRVTMKTTATFAELVITPSERPDKGIYTLTLENPVSSVSGEINVNVIARPGAPKELKVVDVSRSTVQLSWEPPEDDGGSPVIDYIIEKREVSRKTWIKVMDHVMDQEFSVPDLIQGKEYLFRVCACNKCGPGEPAYIDEPINMSAPATVPDPPENVKWRNPTSKGIFLTWEPPKYDGGARIKGYLVEKSQRGTDKWEICGEPVIETKMEVTKLKEGEWYAYRVKALNRIGASKPSKPTDDIQAIDAKEAPEIFLDVKLLAGLTVKAGTKIELPAKITGKPEPQITWTKAEKILRPDDRITIETKPDHSTVTITDSKRSDSGTYIIEAVNSSGRATAVVEVNVLDKPGPPAAFDVSEITNESCLLTWNPPRDDGGSKITNYVLEKRATDSEIWHKLSSTI

SEQ ID NO: 2399 - protein, 332 aa, Meleagris gallopavo
MSLKDHLIHNVHKEEHPHAHNKISVVGVGAVGMACAISILMKDLADELTLVDVVEDKLKGEMLDLQHGSLFLRTPKITSGKDYSVTAHSKLVIVTAGARQQEGESRLNLVQRNVNIFKFIIPNVVKYSPHCKLLIVSNPVDILTYVAWKISGFPKHRVIGSGCNLDSARFRHLMGERLGIHPLSCHGWIVGEHGDSSVPVWSGVNVAGVSLKALHPDMGTDADKEHWKEIHKQVVDSAYEVIKLKGYTSWAIGLSVADLAETIMKNLRRVHPISTAVKGLHGIKDDVFLSVPCVLGSSGITDVVKMILKPDEEEKIKKSADTLWGIQKELQF

SEQ ID NO: 2400 - protein, 3098 aa, Meleagris gallopavo
QIAWYKDGKRIRHGERHHMEVLQDGSASLRLPVVLPEDEGIYTVFASNMKGNAICSAKLYVEPLAPTAAPGYMPGPEVMRRYRSISPRSPSRSPARSSPSRSPARRLDETDEGQLERLYKPVFVLKPTSVKCSQGQTARFDLKVVGRPMPETYWFHNGQQVVNDYTHKIVIKEDGTQSLIIVPAMPEDSGEWAVIAQNRAGKASVTVTLSVEAKEDLVRPRFVERLKNVSVKEGSRLHMSVKATGNPNPDIVWLKNSDIIVPHKYPRIKIEGTKGAAALKIESTVRQDAAWYTATAINKAGRDTTRCKVNVEVEHAEPEPERRLIIPKGTYKAKEIAAPELEPLHLRYGQEQWEEGDLYDKEKQQKPFFKKKLTSLRLKQFGPAHFECRLTPIGDPTMVVEWLHDGKPLEAANRLRMINEFGYCSLDYGVAYSRDSGVITCRATNKYGTDHTSATLIVKDEKSLVEESQLPEGRRGMQRIEELERMAHEGALPAVAVDQKEKQKPELVLVPEPARVLEGETARFRCRVTGYPIPKVNWYLNSQLIRKSKRFRLRYDGIHYLDIVDCKSYDTGEVKVTAENPEGFIEHKVKLEIQQREDFRSVLRRAPEPRHEPVVTEPGKLLFEVQKIDKPAEATTKEVVKLKRAERITHEKLSEESEELRSKFKRRTEEGYYEAITAVELKSRKKDESYEEMLKKTKEELLHWTKEIPEEEKKALPPEGKITIPTFKPEKVELSPSMEAPKIFERIQSQTVAQGTDAHFRVRVVGKPDPECQWFRNGVQIERTDRIYWYWPEDNVCELVIRDVTSDDSASIMVKAVNIAGETSSHAFLLVQAKQLISFIQNLQDIVAKERDSMATFECETSEPFIKVKWFKNGIEIHSGEKYRMHSDRKAHFLSVLAVEMSDADDYSCALVEDESVKTTAKLTVEGAVVMFIKELEDVEIPESFTGELECEVSPEDIEGKWYHGDVELSSNHKYVLASRRGRRILTIKDVNKDDQGEYSFVVDGKRTHCKLKIKPRPMTILEGLTDQKVCEGDIVQLEVKVSLENVEGVWMKDGHEIQSSDRIHIVLDKQSHMLLIEDATKEDGGTYSFSIPGLELSTTGQVTVYSVEIIVPLKDVHVVEGTKAILECKVSAPDVTSSKWYLNDHQIKPDERVQAVCKGTKQRLVVTRTHASDEGHYKLMVGKVETSCNVTVEEIEIIRGLRDITCTETQNVSFEVELSHSGIDIIWHFKGQEIKAGPKYKIEVHGKIYKLTVVKMMKDDEGEYVFYAGGKKTSGKLIVAGGAISKPLTDLTVAESQRAVFECEVANPESEGQWLKNGKPLPRTDQYRAETDGVKRRLNIPATKMDDMGEYSYEIASSKTSAKLHVEAVKIKKTLKNLTVTETQEAVFSVELSHPDVKGALWIKNGVELESNDKYEISVKGTVHTLKIKHCVVTDESVYSFKLGKIGANARLHVETVKIIKKPKDVTALENAVVSFELSVSHDTVPVRWFHKNVELKQSDKYKMISQRKVHKLMLHNISPADAGEYTAFVGQLECKAKLFVETIHITKTMKSIEIPETKTASFQCEVSHFNVPAVWLKNGVEIEMSEKFKIVVQGKLHQLNIMNTSSEDSAEYTFVCGNDRVSATLTVKPILITSMLEDINAEEKDTITFEVTVNYEGISYKWLKNGVEIKSTDKCQIRTKKLTHSLSIRNVHFGDAAEYSFVAGKAASSATLYVEARHIEFRKHIKDIKVVEKKRAIFECEISEPDVQVQWMKDGQELQIGDRMKIQREKYVHRLIIPSTKMSDAGQYTVVAGGNTSSANLIVEGRDIRIRSIRKDIQVIERQRAEIEFEVNEDDIEPQWYKDGIEINFHYEERYSYVVERRIHRMSIFETTYSDAGEYTFVAGRNRSSVVLYVNAPEPPQIIQELQPTTVESGKPARFCAVISGKPQPKVSWYKDDQQLSPGFKCKFLHDAQEYTLLLIETFPEDSAVYTCEAKNDYGVATTSASLSVEIPEVVSPELEVPVYPPAVIVPLRDAVTSEGQSARFQCRVTGTDLKVSWYSKDREIKPSRFFRMTQFEDTYQLEIAEAYPEDEGTYTFVATNSVGQVTSTATLKLEAPEKIMYEKLEEEIEMEMKVAPILRRRLEPLEVAVNHMAKFTCEVETTPNVKFQWYKAGREIYDGDKYSIRSSNYLSMLEIPRPQVVDCGEYSCKASNQHGSVSSTAFLTVTEPPRFIKKLDSSRLVKQHDSTRYECKVGGSPEIKVTWYKGETEIHPSEKYSMSFVDSVAVLEMHNLSVEDTGDYSCEAQNPAGSASTSTSLKVKAPPAFTKKPHPVQTLKGSDVHLECELQGTPPFQISWYKDKREIRSSKKYKVMSENYLASIHILNVDTADVGEYHCKAINDVGSDSCIGSVTLRAPPTFVKKLSDVTVVVGETIELQAAVEGAQPISVLWLKDKGEIIRESENLWISYSENVASLKIGNAEPTNAGKYICQIKNDAGFQECFAKLTVLEPAVIVEKPGPVKVTAGDSCTLECTVDGTPELTARWFKDGNELSTDHKYKISFFNKVSGLKILNAGLEDSGEYTFEVKNSVGKSSCTASVQVSDRIIPPSFTRKLKETYGQLGSSAVLECKVYGSPPILVSWFHDGQEITSGEKYQATLTDNTCSLKVNGLQESDTGTYSCTATNVAGSDECSTFLSVREPPSFVKKPEPLNVLSGANITFTSIVRGSPPLQVKWFRGSVELAPGHKCNITLQDSVAELELFDVQPLQTGDYTCQVSNEAGKISCTTHLFVKEPAKFVMKVNDLSVEKGKNLILECTYTGTPPISVTWKKNGIILKHSEKCSITTTETSAILEIPNSKLEDQGQYSCHIENDSGQDNCHGAITILEPPYFVTPLEPVQVTVGDSASLQCQVAGTPEMIVSWYKGDTKLRGTATVKMHFKNQVATLVFSQVDSGDSGEYICKVENTVGEATSSSLLTVQERKLPPSFTRKLRDVHETVGLPVTFDCGIAGSEPIEVSWFKDNVRVKEDYNVHTSFIDNVATLQILKTDKSLMGQYTCTASNAIGTASSSGKLVLTEGKTPPFFDTPITPVDGIIGESADFECHVSGTQPIRVTWAKDNQ

SEQ ID NO: 2401 - protein, 376 aa, Meleagris gallopavo; identical to SEQ ID NO: 726

SEQ ID NO: 2402 - protein, 3937 aa, Meleagris gallopavo
SSNYLSMLEIPRPQVVDCGEYSCKASNQHGSVSSTAFLTVTEPAVFVKKLSDQYVEPGKPIILEGTYTGSLPISVTWKKNGHTLAQSHKCSITTTEKSCILEILDSTKEDAGEYTCHVENEAGRDVCEAVVSTLEPPYFVTHLEPLEVSVGDYTTLQCHVAGTPEITVSWYKGDTKLRSTPEYKVFFKDNIASLTFNKVVINDSGEYICKAENSVGTASTKALLTVQERKRPPSFARRLKDIEHPVGLPLKLMCRLNGSEPITVTWHKDGVQLSDDHSVHTSFVDNVAVLQLVQTEMNHSGQYTCTATNAVGTANTSARLTVTEPKQAPVFDTKPESIDVPFGESADFECHVTGAQPIQITWSKDGREIRTGGNFNITFVANTAHLRVLRVGKGDSGQYTCQASNEAGKDFCSAQLTVKAEPPKFIKKPEALQFVRQGDTVQLECKITGTPEIKITWYKNDQALQASNRLHMSFVESTAVLTILDASAEDAGDYICEAQNSAGAASCSTSVSVKEPPVFSKVPSPVDTLKGSDVILQCEIAGTPPFEVAWFKDRRQVRSSKKFKVTAKHSIASLHILSLESQDTGEYQCKAMNEVGSDTCTCPVKFKASEPPRFTKKLSDTAIFVGEPTALQAVVEGSPPISVVWLKDKGEVIRESENVQMWFMDNIATLEIASAEGADVGKYICQIKNDAGMRECSAFLQVLEPAVILEKTEPITVMAGNPFTLECRVGGTPELITKWYKDGRELRSDRKYQITFFNNISTLKVFSAEKSDRGLYTFEVHNEVGDSSCTSSVDVSDRLVPPSFSRKLKETNGVLGSSVLLECKVSGTSPMSVAWFQDGNEIVGGEKYEISFLDNICALKLNALDVTDTGPYTCVATNVAGSDECSAFLTVQEPPSFVKTPDPQEVLPGSSVTFTSHIKGSTPFKVTWFRGIRELVPDSTCSISLDESKAQLQLFNVEPGSSGDYACVVTNDAGSASCTTQLFVKEPAVFMKKLSDFSVEQGKSIVLESIYTGTPPISVTWKRNGMPIAQSQRCSVTTTDKSGILEIFNSTKSDEGEYTCEVSNEAGGDVCHSLVSILEPPYFITHLDRVEVKIGEPLVLKCQIGGAPEIKVSWYKEDTKLRSTQAYKMHFKNNVATLAFSTVEDGDIGEYTCKAENSVGFATSTALLVVKERQLPPTFARKLKDIQETVGAPVTFDCRINGSEPIQVSWYKDGVLLSDSDNVQSTFLNNVATLQILQTSMAYCGQYTCSAQNLGTASSSAKLLLTEHLQPPFFDIKPVSIDVALGERATFKCHVTGSAPMRIVWTRDNREIRPGGNYKMMLVENTASLVVLKVGKGDAGLYTCTASNSVGKDACAAQLAVQEPPRFIKKLDSSRLVKQHDSTRYECKVGGSPEIKVTWYKGETEIHPSEKYSMSFVDSVAVLEMHNLSVEDTGDYSCEAQNPAGSASTSTSLKVKAPPAFTKKPHPVQTLKGSDVHLECELQGTPPFQISWYKDKREIRSSKKYKVMSENYLASIHILNVDTADVGEYHCKAINDVGSDSCIGSVTLRAPPTFVKKLSDVTVVVGETIELQAAVEGAQPISVLWLKDKGEIIRESENLWISYSENVASLKIGNAEPTNAGKYICQIKNDAGFQECFAKLTVLEPAVIVEKPGPVKVTAGDSCTLECTVDGTPELTARWFKDGNELSTDHKYKISFFNKVSGLKILNAGLEDSGEYTFEVKNSVGKSSCTASVQVSANTDRIIPPSFTRKLKETYGQLGSSAVLECKVYGSPPILVSWFHDGQEITSGEKYQATLTDNTCSLKVNGLQESDTGTYSCTATNVAGSDECSTFLSVRDLEPPSFVKKPEPLNVLSGANITFTSIVRGSPPLQVKWFRGSVELAPGHKCNITLQDSVAELELFDVQPLQTGDYTCQVSNEAGKISCTTHLFVKEPAKFVMKVNDLSVEKGKNLILECTYTGTPPISVTWKKNGIILKHSEKCSITTTETSAILEIPNSKLEDQGQYSCHIENDSGQDNCHGAITILEPPYFVTPLEPVQVTVGDSASLQCQVAGTPEMIVSWYKGDTKLRGTATVKMHFKNQVATLVFSQVDSGDSGEYICKVENTVGEATSSSLLTVQERKLPPSFTRKLRDVHETVGLPVTFDCGIAGSEPIEVSWFKDNVRVKEDYNVHTSFIDNVATLQILKTDKSLMGQYTCTASNAIGTASSSGKLVLTEGKTPPFFDTPITPVDGIIGESADFECHVSGTQPIRVTWAKDNQEIRTGGNYQISYVENTAHLTILRVDRGDSGKYTCYASNEVGKDSCTAQLNVKERKTPPTFTRKLSEAVEETEGNELKLEGRVAGSQPLTVSWYKNNQEVHSSPHCEISFKNNTLLLHIKSVGQSDAGLYTCKVSNEAGSVLCTSSVVIREPKKPPVFDQPLQPAATEEGNTLQLSCHVRGSEPIRIQWLKAGREIRASERCSFSFANGVALLELAAVTKSDSGEYVCKASNVAGTDTCRSKVTVKEKAAALPAAKKADMEGKLYFVSEPQSIKVMEKTVATFIAKVGGDPIPNVKWMKGKWRQLNQGGRIIIQQRGDEAKLEIKDTTKTDSGLYKCVAFNQHGEIERSVNLQVEERKQEVVEEDVRGKLKRIPTKKKEDEEQTIDILELLKNVDPKEYEKYARMYGITDFRGLLQAFELLKQTREEESHRLEIELTEKAQKEDQEFEELVAFIQQRLTQTEPITLIRDIENQTVLTDEDAIFECEIKINYPEIKLSWYKGTQKLDSSDKYEIKIEGDRHILKIRNCQLEDQGNYRIVCGPHIASARLTVIEPAVERHLHDTTFKEGNTCTLSCQFSIPNAKSQWYRNGRPIKIGGRYSTQVSDKVHKLIIKDVRTEDQGQYTCKLDNLETSADLAIEVSKTAEPIQFTKSIQNIVVSEHQSATFECEVSFDDAVVTWYKGPTELRESPKYSFRSEGRCHYMTIHNVTAEDEGVYSVIARLEPRGEARSTAELYLVTKEIKLELKPPDVPDAKVAVPPQKPAEEAAPIPILLPLIPPPEEKKPAEKKVPVKKVSKKVVKKGAKEIPPPEETKKPTTNTLLKIASAYVKSYRSYKKKTSHNTVCNKELISLTVNIQYTLQIPGYDDNMVVLVPEILPEKPKEVKITSMARREGIHEEKMEIYEKPKEVYEEWEEDYGEDHDYYFKEEGYDEEEEEWEETYEKREVAYEEKQIIHEEAIIAEKKEKKEVTVHKVVKKPVDEKVEITTQRVAEEKLKRAEVTKKIPPAKPTPMIVEEKVMKKEVPTVERWTVSEEKMSVSVHREEEYSYVTVPEVPKKPLPEEKVHIPVPKAEPPPVKEVPAVPKKPVPKEKVPPAVPKKVEAPPAKVPEVHKKVTPKEKVPVPVPKKVEAPPSREMSAVPKKTVPEEKVPVPVSRKVAAPPAKVPEVRKMVVQKEKVYIEVPQDEEEEEIPQYEEVTKYEKEVIHYEEEVQHYEEVSHYEEEAPQYEEVPQYEEEEVTREEEEAAYYEDQNNVFEVPEVPKKPEPEKKVQVPKKKEAPPPKVPEVPKKPVPEEKVLVPVPKKVEEPPSAKVPEAPKKVVPEEKIPIFIPEKEEETIPEKAIPTKVPEMPKKPVPEEKVPIPKKVPVPPEKVPEVPKRPLPEEKVPVPVPKKEAPPAKVPEVPKKVVPEEKVHVEVPKKPEPPPPKEPEVPKKIVPEKKLPEPVAVPEKPEPLPEKVPGLVKKPRRIIPEVTPPPKEEVVLKRVLRKKPEEEEPKPEKEPKPEVKPVPTPVEKISEVPKKKPEIPVIKKEEKHVPEPPKEPKQAAISVPGPEPKPAVALKSPKPAAEPAPAITTAPVTTPVVGKKAEAKPTKEETPKGISPVKGKTKKTPSPADAERRKLRPGSGGEKPPEEPPFTYQLKAVPLKFVKEMKDIVLKEAESVGSSAIFEVLISPSTAITSWMKDGS

SEQ ID NO: 2403 - protein, 3005 aa, Meleagris gallopavo
IHMPVDAMSLQAAKECQTLVSDVDYRHYLHQWTCLPDHNDVVHARKAYDLQSDNVYKSDLEWLRGIGWLTEGSVDVVKAKKAQEILSDRLYRTLPDQMKFTSVTDSPDVVQAKINAMQLSNRLYREAWDKDKAQISIPSDTPEMLQSKLNALNISNKQYQKAWDEAKAKSYDLRADAIPIKHAKASRDIASEYKYKETHEKQKGHYIGCRTAKEDPKLSWAARAMLLQNDRIYRKAYNDSKAHIHMPVDAMSLQAAKECQTLVSDVDYRHYLHQWTCLPDHNDVVHARKAYDLQSDAVYKSDLEWLRGIGWLPNDSPGIRRVKHAQDLLSDKVYRTPIDSLKYTSVVDSPDILLAKVNAEQLSIPKYKEAWEKDKTMIHIMPDTPEINLAKSNAHNYSQKLYREAWDEVKMSYDLRADAIPIKAAKASREIASDYKYKLDHEKQKGHYVGVPNAKADTKMQFALGIGKVQSELEYKKHFAKWKTQCHLPVDMLSIQSAKHGQSLVSDVDYRHYLHQWICLPDQNDVIHARKAYDLQSDAVYKSDLEWLRGIGWLPNDSLGINHVKHAGDLLNERKYRTKVETLQFTPVTDRVDYVTAKKSGEILSDIKYHKAWNEVKSNYTLTDTPQLDMAREAARILNQSLYKESWEKEKATGYLLPPDTVQICHAQHSNDVQSELKYKADYVKQRGHYVGVASMRDDPKLVWFEHAGEIQNDRLYKSNYHKTKSKIHIPADIMSVVAAKECQALVSDVDYRHYLHQWTCHPDQNDCIQARKAYDLQSDNIYKSDLEWLRGCGWIPLDSVEHKKVKHAQELINKRAYTKDALENFSKFTSVVDTPDIVLAKINSVNQSDLKYKETFNLEKGQYIGSDDTPELNHARDMSLLYSDKLYKRDWEISKPIGYTLDTTYIPLVGAKHANYVNSERKYKELYEKLKGHYLAGKDIGDFPSVVHSLAFQKIRSALAYRKNYEDTKTRVHIPSDMMNHVLAKKCQYILSDLEYRTYLHHWNCSPEEHDVIQARRAQEILSDVVYKDDLNWLKGIGCYVWDTPQILHAKKSYDLQSQIKYTAAGKENFQNFGVVTDTPVYVTAVQSTINASDVKYKEDYHKTKDKYTTVTETADSERVQNLKHLFSNNLYKEAWDRVKATSYILPSDAVSLARAKELKHNASTVKYREEYEKFKALYTLPGSVEDDPNTARCLRVGKLNIDRLYRETYEKNKAKVHIVPDMVDIIAAKDAQQKISEIDYRTRLHDWICLPDLQINAHVRKVADQISDVVYKDDLNWLKGIGCFVWDTPEILHAKHAYDLRSDIKYKSDAEKTKSKYTVVMDTPVYVQNILSGLNASEVVYRGDYLNKVRGKMIPTDKTVDLERAHHANKIQSENLYRWAGLKALPTGYSLPKDTPGFQHAKHVQYIGSDLKYKEAYEHMKAKGYTLGPNDVGFENVKKVNQVINERLYRATYHKNKDKIHTTPDTPEIRQVRATQEAVSDLIYKSDFFKMQGHLISLPFTPQVLHCRYVGDITSDNKYKEDLKWLQGLGCFLYDTPDMVRARQLRKLWSNYVYTDSAKKMRDKYSVVLDTPGYRTVQELKTHLSDLVYRAAGKELKTKYTSVLDTPDFLRAKKGQKIQSQYLYVELATKERPHHHAGSQTPAFTHARHVKDMVSETKYKIQYEKMKDKYTPVLDTPVLIRAKRAYLNASDLRYKETFENTKGKYHTVKDALDIVYHRKVTDDISSVKYKENYMSQLGVWRSIPDRPEHFHHRIVTDAISDVKYKEDLSWLRGIGCYAWDTPDFTLAGKNKVLYSGHKYKEMFEKTKSHFQYVADSPINRHFKHATQLLDAKLYKAAYEKLKDRYSVIVDDPKNLLAKWGTTLSSQVEYKKDYEKKKDKYTTVVDTPENLRTAKVNKQISDIIYKLEYNKAKPKGYTTIHDTPMLLHVRKVKDRISDLKYKEVYERNKSHCNVVADSVHIKTPRHAYKLNSNLDYKKKYEAAKAHWHWIADRPDFVQAAKSSLQQSDYEYKLDREFLKGCKLSVTDDKNTVLALNNAILASDIKYKEKHNKARGTCLVVPDTPQILLAKNVSSLVSENKYKEHSKKQLPRGSYTTLPETRDTAHVKEVTKNVSDTNYKKNFVKEKGKSNYSIMLEPPEVKHAMEVAKKQSTIEYKKDAKSKLHYTPIADRPDIKKATQAAKLISDIEYKKRGEAGLGVTMLGRPDIELAKEVSKLTSQVKYKENFSKEKGKRPKYDLKEAKIYKTMKDAHNMASEVKYKADLKKLHKPVTDMSESLIMNHVLNTSQLASAYQYKKQYEKSKGHYHLVPDNLEQVHLREASELQSHVKYKEKYEKEKGKPMLDFETPTYLTAKESQLMQSEKEYKRDFEESIKGRNLTGLEITPSLLHVKYATKIASEKEYRKDLEEGVKGKGLSVLEETPDMLRAKNATQILNEKEYKKALELEIRGKGLSELALETPDFVRAKNATDIASQIKYKQLAEMEKANYTSVVDTPEIIHAQQVKNLSSQKKYKEEAERTMPYYVPVADTPEMQRVRENQKNFSTLQYQWDLQNSKGKVTVVQDTPEMLRVKENQKNFSSILYKEDIGTGTTIEKTPEMQRVKRTQDAISSIKYKESIGKGTPIPDLPEVKRVKETQKHISSVLYKEELGTGIPTPVTPEIERVRRNQEHISSVLYKENVGMGTPTPVTPEIERVKRNQEHVSSVLYKENVGKVTPTPITPEMERVKRNQEIISSVLYSDSFRKQVQGKAAYVLDTPEMRRVRETQKHISTVKYHEDFEKNKGTFTPVVTDPITERVKKNMQDFSDISYRGIQRRVVQMEQKRVDQDQENLTGLRVWRTNPGSVFDYDPAEDNIQSRSLHMISVQAQRRSREHSRSASALSISGGDEKSEPSEGLNQHLSYYSNEGFFTTTATGYKHAKTIELPQQRSASVATQQTTVSSVPSHPSTAGKTYRAMYDYTAADADEVSFKDGDTIVNVQAIDEGWMYGTVQRTGKTGMLPANYVEAV

SEQ ID NO: 2404 - protein, 1450 aa, Meleagris gallopavo
  MOD_RES (119)..(120): Any amino acid
MSSVAVPFYQKRHKHFDQSYRNIQTRYVLEEYAARKAASRQAAHYESIGLGKTTCRLCARRARSLAHEAMQESRKRTHEQKSHASDEKRIKFASELSSLEREIHLARHHAREQLDRLAXXFFVEENMALERHAVEEKISRAPEILVRLRSHTVWEKMSVRLCFTVQGFPSPVVQWYKNEELITPASDPAKYTVENKYGVHVLHINRADFDDSATYSAVATNIHGQASTNCAVVVRRFRESEEPHPAGIMPFHLPLSYDVCFTHFDVQFLEKFGVTFATEGETLTLKCSVLVTPELKRLRPRAEWYRDDVLIKDSKWTKLYFGEGQAALSFTHLNKDDEGLYTLRMVTKGGVNEYSAFLFVRDADALIAGAPGAPMDVKCHDANRDYVIVTWKPPNTTTQNPVIGYFVDKCEVGLENWVQCNDAPVKICKYPVTGLCEGRSYIFRVRAVNSAGISRPSRISEPVAALDPVDLERTQTVHVDEGRKIVIRKDDLEGDIQVPGPPTNVHASEISKTYVVLSWDPPVPRGREPLTYFIEKSMVGSGSWQRVNAQVAVKSPRYAVFDLAEGKPYVFRVLSANKHGISDPSEITEPIQPQDTIVVPSAPGRVVATRNTKTSVVVQWDKPKHEENLYGYYIDYSVVGSNHWEPANHKPINYSRFVVHGLETGEQYIFRVKAVNAVGFSENSQESEAIKVQAALTCPSYPHGITLLNCDGHSMTLGWKAPKYSGGSPVLGYYIDKREANHKNWHEVNSSLICRTIYTVEDLTEDAFYEFKIAAANMVGIGHPSDPSEHFKCKAWTMPEPGPAYDLTICEVRNTSLVLLWKAPVYEGKSPITGYLVDYKEVDTEDWITANEKPTSHHYFKVTDLHQGHTYVFKVRAVNDAGVGKSSEISEPVFVEASPGTKEIFSGVDEEGNIYLGFECKEATDASHFLWGKSYEEIEDSDKFKIQTEGDHSKLYFKNPDKSDLGTYCISVSDTDGVSSSFILDEEEFERLMAISNEIKNPTIPLKSELAYEVLDKGEVRFWIQAESLSPNSTYRFVINDKEVENGDRHKISCDHSNGIIEMVMDKFTIDNEGTYTVQIQDGKAKNQSSLVLIGDAFKTVLAESELQRKEFLRKQGPHFSEFLYWEVTEECEVLLACKVANTKKETVFKWYRNGSGIDVDEVPDLQRGECHLTIPKLSRKDEGVYKATLSDDRGHDVSTLELSGKVYDDIILALSRVSGKTASPLKILCTEEGIRLQCFLKYYNEEMKVIWSHRESKISSGEKMKIGGGEDVAWLQITEPTEKDKGNYTFEIFADKGSFKRTLDLSGQAFDDALTEFQRLKAAAFAEKNRGKVIGGLPDVVTIMDGKTLNLTCTVFGNPDPEVVWFKNDKTLELNEHYLVSLEQGKYASLTIKGVTSEDSGKYSIYVKNKYGGETVDVTVSVYRHGEKIPEVKQGQLAKPRLIPPSSST

SEQ ID NO: 2405 - protein, 108 aa, Meleagris gallopavo
GMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 2406 - protein, 400 aa, Meleagris gallopavo
FRVDFNVPMKDHKITNNQSCSRIKAAVPTIKHCLDHGAKSVVLMSHLGRPDGVPMPDKFSLAPVAVELKALIGREVLFLKDCVGPEVEKACANPANGSIILLENLRFHVEEEGKGKDASGNKIKADAAKVEAFRASLSKLGDVYVNDAFGTAHRAHSSMVGVHLPQKAAGFLMKKELDYFAKALESPERPFLAILGGAKVQDKIQLISNMLDKVNEMIIGGGMAFTFLKVLNNMQIGNSLFDEEGSKIVKDLMAKAEKNGVKITLPVDFITADKFDEHAQTGEATVASGIPAGWMGLDCGPESVKKFVEVVGRAKQIVWNGPVGVFEWDKFSKGTKALMDKVVEVTGKGCITIIGGGDTATCCAKWNTEDKVSHVSTGGGASLELLEGKVLPGVDALSNV

SEQ ID NO: 2407 - protein, 894 aa, Meleagris gallopavo
AWEKDKTNVHIMPDTPGILLAQQNQVNFSEKMYRLAMEEDKKKGYDMRADAIPIKSAKASRDIASDYKYKEGYRKQLGHHIGARNIEDDPKMMWSMHVAKIQSDREYKKAFEKTKTHFSSPVDMLGIVLAKKCQELVSDVDYRHYLHQWICLPDQNDVIHAKKAYDLQSDAVYKSDLEWLRGIGWVPIGSLDVEKAKKAGEILSERKYRQPADQIKFTSVTDSLAMMLAKHNAEIMNKRLYTEAWDADKTSIHVMPDTPTILLAKANAANVSHKHYIQAWEDAKTKGYDMRADAIPIRSAKASRDIASDYKYKEAHEKQKGHYIGCRTAKEDPKLSWAARAMLLQNDRIYRKAYNDSKAHIHMPVDAMSLQAAKECQTLVSDVDYRHYLHQWTCLPDHNDVVHARKAYDLQSDNVYKSDLEWLRGIGWLTEGSVDVVKAKKAQEILSDRLYRTLPDQMKFTSVTDSPDVVQAKINAMQLSNRLYREAWDKDKAQISIPSDTPEMLQSKLNALNISNKQYQKAWDEAKAKSYDLRADAIPIKHAKASRDIASEYKYKETHEKQKGHYIGCRTAKEDPKLSWAARAMLLQNDRIYRKAYNDSKAHIHMPVDAMSLQAAKECQTLVSDVDYRHYLHQWTCHPDQNDCIQARKAYDLQSDNIYKSDLEWLRGCGWIPLDSVEHKKVKHAQELINKRAYTKDALENFSKFTSVVDTPDIVLAKINSVNQSDLKYKETFNLEKGQYIGSDDTPELNHARDMSLLYSDKLYKRDWEISKPIGYTLDTTYIPLVGAKHANYVNSERKYKELYEKLKGHYLAGKDIGDFPSVVHSLAFQKIRSALAYRKNYEDTKTRVHIPSDMMNHVLAKKCQYILSDLEYRTYLHHWNCSPEEHDVIQARR

SEQ ID NO: 2408 - protein, 1736 aa, Meleagris gallopavo
VLYKQNWEENKDKYLLPPDAPELVNAIKNTAMFSKKLYTEDWEGDKTLFYPYNDSPELRRVAQAQKALSDIVYKKGHDERKSKYTSLPDPPDVEQAKKVTRQLSDELEWQKKYQRAKEKSKPQDLFDFFSSETSQQILSSLNSKFSCDFHYSEPSLIEITCTRKAMYISLQVIYHEDYKNKIKDYNVLPATENPLLRQLKTAGDVLSDHTYKKHPDQIKFTQVTDSPVQKQAEINSKQLSDKLYRSSGEEVIHKYTLPPDVPQFIQARYNAANVSDAYYKQDYHDLIAKGTNVSLDAIPITRAKASRNIASDYKYKEAYEKAKGKQVGFRSLQDDPKLVHYMHVAKIQSDREYKKDYEKSKTNYHTPPDTFSIQAAKKSQDVASTAHYKNLIHHYTYLPDAMDVELAKNMMQIQSDNVYKQDYNSWFKGIGWSPLGSLDVEKAKKAGDALNEKRYRQHPDTIKFTSVPDSMTMVLAQHNTKQLSDVAYKQEGEKVKHKYKLDPDVPQFIQARVNAFNLSDANYKADWKKTIAKGYDLKPDAIPIIAAKASRNIASDYKYKESYEKDKGKHVGYRSLQDDPKLVHYMHVAKLQSEREYKKDYEVTKTKYHTPLDMFSVTAAKKAQEAVTNTGYKQPIHHYTLLPDSVNLELSRNMMQLQSDNVYKADFNNWLRGVGWLPIQSLDVEKAKKASDILSEKKYRQHPDKLKYSIPLDAMEQVLAKQNAKTMNKRLYTDKWNKEKTSIHVMPDTPEILQSRVNQITMSNKLYKAGWEEEKKKGYDMRPDAIPIKAAKTSQDIASDYKYKLAYEQAKGKHIGFRSLEDDPKLVHFMQVAKMQSDREYKKDYEKAKTNFHTPVDMLSVVAAKKAQEVATNANYKNLIHIYNVLPDAMSLELAKNMMQIQSDNQYRADYDESMKGVGWMPLGSLEAEKNKKAMEILSEKKYRQHPDKLKYSVPVDSMNMALALHNAKIMDEHQYKQAWEEDKKKVHITPDIPQFALAKANAFNISDKMYRHSFEEARKKGYDLRSDAIPIKAAKASRDIASDYKYKLGYEQDKGKLVGFRSLQDDPKLVHYMQVAKMQSDREYKKAYEASKTHYQTPSDALSIVAAKEAQDRVTNANYKRLIHHYMLLPDAMSFELCRNMNQIQSNNEYKQDYNEWFRGIGWSPVGSLDVEKSKKATEIASDQKYRQHPSTFSFTKQTDAMDMVLAKHNADIMNKHAYTQAWEKDKTQVHVMPDTPDILQAKQNMANYSQKQYKLGWEEMIKKGYDLTPEAISVKAAKASRDIASDYKYKEGYRKQQGHHIGFRSLQDDPKMMWSMQVAKMQSEREYKKDFEKWKTKFNMPVDMLGFLLAKKCQELVSDVDYKHMLHRWTCLPDQNDVTQAKRVYELQSDNLYKSDLQWLRGIGWSPLGSLESEKNKKASEILSEKKYRQHPDTIKFTSIPDAMNITLAKSNAKNRSDILYREAWDKDKTQVHIMPDTPEILLAKSNLINTSDKHYKLGYEELRRKGYDLPPDAIPLKAAKASRDIASEYQYKTAYRKQLGHHIGARNIEDDPKMMWSMHVAKIQSDREYKKAFEKTKTHFSSPVDMLGIVLAKKCQELVSDVDYKHLLHRWTCLPDQNDVVQARKVYDLQSDNVYRSDLQWLRGIGWSPLGSLDEDEEKNKRASMILSDKKYRQHPDTIKFTSLPDSMPMVLAKHNSDIMNHRSYIAAWEKDKTNVHIMPDTPGILLAQQNQV

SEQ ID NO: 2409 - protein, 688 aa, Meleagris gallopavo
  MOD_RES (1)..(1): Any amino acid
XRTREGRLKAARNLVKRGITNLCVIGGDGSLTGADTFRAEWSSLLAELLKTGGITAEEAKKSSYLNIVGMVGSIDNDFCGTDMTIGTDSALHRIMEIVDAITTTAQRELGTCVPEVMGRHCGYLALITSLACGADWVFIPESPPEDGWEDHLCRRLTETRLGGSRLNIIIVAEGAIDRHGKAITSDEVKDLVVKRLGYDTRVTILGHVQRGGTPSAFDRILGSRMGVEAVMALLEGTPDTPACVVSLSGNQAVRLPLMECVQVTKDVTTAMNEKRFDDAVKLRGRSFQNNWNVYKLLAHIRPPSTKSGYTLAVLNVGAPAAGMNAAVRSTVRIGLIHGHRMLAVHDGFEGLAYGKVEESSWDKVGGWTGLGGSKLGTKRTLPKKYFEEISATISTFGIHGLIIIGGFEAFMGSLELMEGRAKFDELCIPICVIPATVSNNVPGSDFSIGADTALNTITTTCDRIKQSAAGTKRRVFIIETMGGYCGVPGHHAGLAGADAAYIFEEHFSIRDLQINVEHLTEKMKTTVKRGLVLRNEHCNENYTTDFIYNLYTEEGKGIFDCRKNVLGHMQQGGTPTPFDRNFGTKMGAKSVAWITGKIKECSRHGRIFANTADSACLLGMRKRSLVFQPLIELKEQTDFEHRIPKEQWWLKLRPILKILAKYNIELDTSEKALMEHVRHKRVSQEYNM

SEQ ID NO: 2410 - protein, 574 aa, Meleagris gallopavo
RKRVTVFQNNAHYAENFIQSILATVPPAERQEATLVGGDGRFYMKDAIQIIVRIAAANGIGRLVIGQNGILSTPAVSCIIRKIKAIGGIILTASHNPGGPNGDFGIKFNTANGGPAPEGITDKIFQISKKIEEYAICPDLKVDLGTIGKQQFDLENKFKPFTVEIVDSVEAYANMLRNIFDFNALKELLSGKNHLKIRIDAMHGVVGPYVKKILCEELGAPANSAVNCTPLEDFGGHHPDPNLTYAADLVQTMKTGEYDFGAAFDGDGDRNMILGKHGFFVNPSDSVAVIAANILSIPYFQQTGVRGFARSMPTSGALDRVAHATKIALYETPTGWKFFGNLMDANKLSLCGEESFGTGSDHIREKDGLWAVLAWLSILAARKQSVEDIMKDHWHKYGRNFFTRYDYEEVDADAAGKMMKDLETVMFDRSFVGKQLSAGDKVYTVEKADNFEYHDPVDGSVSRNQGLRLIFSDGSRIIFRLSGTGSAGATVRLYIDSYEKDAKKIHEDPQVMLAPLISIALKLSQLHERTGRTGPCYNIKTHPGTKGKKAARRVCHYKRNINFICVFKNTARYR

SEQ ID NO: 2411 - protein, 284 aa, Meleagris gallopavo; identical to SEQ ID NO: 1691

SEQ ID NO: 2412 - protein, 613 aa, Meleagris gallopavo
MKWVTLISFIFLFSSATSRNLQRVARDAEHKSEIAHRYNDLKEETFKAVAMITFAQYLQRCSYDGLSKLVKDVVDLAQKCVANEDAPECSKSLPSIILDEICQVEKLRDSYGAMADCCSKADPERNECFLSFKVSQPDFIQPYQRPASDVICKEYQDNRVSLLGHFIYSVARRNPYMYAPTILSFAADYEHALQSCCQESDVGACLDAKETAMREKAKKISVKQQYSCGILKKFGDRVFQAEKLVRLSQKYPKAPFSEVAKLVRESKDVHKECCEGDMVECMDDMAEIINNMCSKQDVFSSKIKGCCEKPIMERSQCIMEAEFDEKPADLPSLVEKYIQDKEVCKSFEAGHDAFMSEFVYEYSRRHPEFSTQLILRIAKGYESLLEKCCKTDNPAECYANAQDQLNQHIKETQDVVKTNCDLLSAHGEPDFLKSILIRYTKKMPQVSTETLLEIGKKMTAIGTKCCQLSEDRRMACSEGYLSIVIHDMCRRQETTPINDNVSHCCSDSYAHRRPCFTAMGVDTKYVPPPFNPDMFSFDEKLCSAPAEEREVGQMKLLINLIKRKPQMTEEQIKTIADGFTAMVDKCCKQSDINTCFGEEKKKIRIINKSLLNL

SEQ ID NO: 2413 - protein, 1634 aa, Meleagris gallopavo
MLKDLQLMPGALQPTAMLLQQTSALSLQQHIAMALQPTTLSQQPTAMDLQPMIMLLRKVRDLLPTVLTLKPSARALLPIVMDLNLSTSWLQPTAWGQRLKIRLKDSNLMIEDQSYKMSPKAKRAKQHLVSEDKENEAIDYSVPIFTGREVNISGITDTEEERIKESAAYVAKRNLFATGEGVSVSKVAKSVSEEEHHEKKSRKVAIRESAERVALKKTLEDTQAFHKKLNQDKLLHPPEFVIKPRSHTIWEKQNVKFHCTVAGWPAPRVTWYKNNVPIDVQAHPGKYTIENRYGLHSLEISTCDFDDIAQYRASAMNVKGEISAYASLVVKRYKGEIDASHLHAGTFSMPLSLGVTPHGFASRFEIKFIDKFEVMFGREGETMSLGCTVVISPDIKRFKPDIEWYRNGVLITPSKWVQMHWTGERASLTLTHANKEDEGLYTLRVVMGEYYEEYSGYVFVRDADAEIPGAPGAPLDVQCLDANKDYVIVSWKQPAVDGGNPILGYFIDRCEVGTTHWTQCNETPVKFARFPVTGLIEGRSYIFRVRAVNRAGVSLPSRVSEAVAALDPADRARLRSHPSAPWTGQIIVTEEEPAEGVIPGPPTDLQVIEATKNYVVLSWKPPGQRGHEGIMYFVEKCIAGTEDWQRVNTEIPVKSPRFAVFDLSEGKSYCFRVRCCNSAGIGEPSEATEATVVDDKLDIPKPPGRIMPTRNTDTSVVVTWTEPPDAKELVGYYIESSVVGSGHWEPCNNNPVKGTRFICHGLVNGEKYIFRVRAVNAAGLSEFSQDSEPIEVQAAIVIGGGLLHETAAPSPPYDITVLESVRDSMVLGWKQPKATGGTEITGYYVNYREVIGGVPGKWREANIKAISERAYRIENLKENMVYQFQVAAANLAGVGTPSLPSKPFKCEEWTIAVPGPPHDVTYTEVRKDSLVLLWKEPVYTGRSPIAGYYIDMKETEAKEEHWRSVNEKPLQKKFLKIAGLTEGVSYVFRVRATNQAGVGRPSDITDPVVAETRPGTKEVVVNVDDDGVISLNFECDQMSPNSKFVWSKNYEPIEDDSRLDIDSKGGKSKAIFKNLGEDDLGIYSCVVTDTDGVSSGYTIDEEEMKRLLALSHERKFPTIPLASELAVEILEKGEVRFWLQAEKLSGNAKANFVFNDKEIFNGEKYKMKVDQRTGLVEMIMDKLEDKDEGTYTFQLQDGKATNQSSLVLIGDVFKKLRDEAEFQRKEWHRKQGPHFVDQLGWEVTDECNVMLKCKVANIKKETHIVWYKDDREIMVDEEHDFKDGVCTLLISEFSKKDTGIYEVILKDDRGKDVSELKLTDTAFADLMNEVCRRIALSATDLKIQSTAEGIRLYSFVTYYVDDLRVGWVHNDTQIRYTDRVKTGVTGEQIWLQINEPTPQDKGKYTMELFDGKTGHKKTVDLSGQAFDEAFAEFQRLKQAAIAEKNRARVLGGLPDVVTIQEGKALNLSCTVWGDPTPEVSWLKNEKSFVSDANCILKFEAGKNVSFTISAVSTHDSGKYSLVVKNKYGTETSDVTVIVITVSGQTDTAKHTVSISGQSQNNITVSKKKKATTMSKPQQEKEKKDIKPHVDEIIATEETSDSKEIPRVEKEKNTENNQQTAKKTHGKAAAARTVP

SEQ ID NO: 2414 - protein, 461 aa, Meleagris gallopavo
QNRAVLHIALRNRSNTPILVDGKDVVPEVNKVLDKMKHFCQKVRSGEWKGYTGKAITDVVNIGIGGSDLGPLMVTEALKPYSKGGPRVWFVSNIDGTHIAKTLAELHPETTLFIIASKTFTTQETITNAVTAKEWFLHAAKDPSAVAKHFVALSTNGPKVKEFGIDTENMFEFWDWVGGRYSLWSAIGLSIALHIGFDNFESLLAGGHWMDKHFHTAPLEKNVPVLLAMLGVWYINCYGCETHALLPYDQYMHRFAAYFQQGDMESNGKYITKKGSRVDYNTGPIVWGEPGTNGQHAFYQLIHQGTRMIPCDFMIPVQTQHPIRNGLHHKILLANFLAQTEALMKGKTADEARKELQAAGLSGDALEKLLPHKVFEGNRPTNSIMFTKLNPFTLGAIIAMYEHKIFVQGVVWDINSYDQWGVELGKQLAKKIEPELESDAAVTSHDSSTNGLISFIKKHRA

SEQ ID NO: 2415 - protein, 212 aa, Meleagris gallopavo
QALRDAGFKFDICFTSVQKRAIRTLWNVLDAIDQMWLPVVRTWRLNERHYGALTGLNKAETAAKHGEAQVKIWRRSFDIPPPPMQSDHPFFSTISKDRRYADLTEDQLPTCESLKDTIARALPFWNEEIVPQIKEGKRVLIAAHGNSLRGIVKHLEGMSEEAIMELNLPTGIPIVYELDKNLKPIKPMQFLGDEETVRKAMEAVAAQGKVKK

SEQ ID NO: 2416 - protein, 220 aa, Meleagris gallopavo
EKPRIKLTAPKIPEGEKVDFDDIQKKRQNKDLIELQALIDSHFEARRKEEEELVALKERIEKRRAERAEQQRIRAEKEKERQARLAEEKARREEEDAKRKAEDDLKKKKALSSMGASYSSYLAKADQKRGKKQTARETKKKVLAERRKPLNIDHLNEDKLRDKAKELWDWLYQLQTEKYDFAEQIKRKKYEIVTLRNRIDQAQKHSKKAGAKGKVGGRWK

SEQ ID NO: 2417 - protein, 220 aa, Meleagris gallopavo
EKPRIKLTAPKIPEGEKVDFDDIQKKRQNKDLIELQALIDSHFEARRKEEEELVALKERIEKRRAERAEQQRIRAEKEKERQARLAEEKARREEEDAKRKAEDDLKKKKALSSMGASYSSYLAKADQKRGKKQTARETKKKVLAERRKPLNIDHLNEDKLRDKAKELWDWLYQLQTEKYDFAEQIKRKKYEILTLRCRLQELSKYSKKAGAKGKVGGRWK

SEQ ID NO: 2418 - protein, 817 aa, Meleagris gallopavo
RESDHRAWTPVSYTVTRQNAVVQGLTEGKAYFFRIAAENIIGMGPFTETTKELIIRDPITVPDRPEDLEVKAVTKNSVTLTWNPPKYNGGSDITMYVLESRLIGKEKFHRVTKEKMLDRKYTVEGLKEGDTYEYRVSACNIVGQGKPSFCTKPITCKDEIAPPTLDLDFRDKLIVRVGEAFSLTGRYSGKPTPKITWLRDDIVLKEDNRTKIKTTPTTLCLGILKSVREDSGKYCVTVENSTGSRKGFCQVTVVDRPSPPVGPVIFDEVHKDHMIVSWKPPLDDGGSEITNYIIEKKDAHRDIWMPVTSATVKTTCKIPKLLEGREYQIRIYAENLYGISDPLISDEMKAKDRFSVPDAPEQPVIKDVTKDSAVVVWNKPYDGGKPITNYIVEKKETMATRWVRVTKDPIFPSTQFKVPDLLEGCQYEFRVSAENEIGVGNPSPPSKPIFARDPIVKPSPPVNPEAVDKTKNSVDLTWQPPRHDGNGKIIGYLVEYQKVGDEEWKKANLTPDSCPETKYKVTGLTEGLTYKFRVMAVNAAGESEPAYVPDPVEVKDRLEPPELILDANMAREQHVRAGDTLRLSAVIKGVPFPKVSWKKEDKEVSPKADIEVTGVGSKLEIRNTAHEDGGIYSLTVENPAGSKTVSVKVLVLDKPGPPRNLQVSDVRSDSCYLTWKEPEDDGGSVITNYVVERKDVASPQWVSVSSTSKKRSHMAKYLMEGTQYLFRVAAENMFGRGPYVETLKPIKAVDPLHPPGPPKNLHHVDVDKTEVSLVWNRPDRDGGAEITGYLVEYQEDGADEWTKFQTVPMLDCVVTGL

SEQ ID NO: 2419 - protein, 212 aa, Meleagris gallopavo
TEVVCGAPSIYLDFARQKLDAKIGVAAQNCYKVSKGAFTGEISPAMIKDIGAAWVILGHSERRHVFGESDELIGQKVAHALAEGLGVIACIGEKLDEREAGITEKVVFEQTKAIADNVKDWSKVVLAYEPVWAIGTGKTATPQQAQEVHEKLRGWLKSHVSDAVAQSTRIIYGGSVTGGNCKELASQHDVDGFLVGGASLKPEFVDIINAKH

SEQ ID NO: 2420 - protein, 406 aa, Meleagris gallopavo
MRATCWILAGFCLLFCCKAEEGLNFPTYDGKDRVIDLNEKNYKHALKKYDMLCLLFHEPVSSDRVSQKQFQMTEMVLELAAQVLEPRSIGFGMVDSKKDAKLAKKLGLVEEGSLYVFKEERLIEFDGELATDVLVEFLLDLLEDPVEIINSKLELQAFDQIDDEIKLIGYFKGEDSEHYKAFEEAAEHFQPYIKFFATFDKGVAKKLGLKMNEVDFYEPFMDDPVHIPDKPYTEEELVEFVKEHKRATLRKLRPEDMFETWEDDMEGIHIVAFAEEDDPDGFEFLEILKQVARDNTDNPDLSIVWIDPDDFPLLITYWEKTFKIDLFRPQIGIVNVTDADSVWMEIRDDDDLPTAEELEDWIEDVLSGKINTEDDDDDDDDDDDDDDDDDDDDDDDDDDDDDDDDD

SEQ ID NO: 2421 - protein, 436 aa, Meleagris gallopavo
MSILKIQAREIFDSRGNPTVEVDLYTNKETGLFRAAVPSGASTGIYEALELRDNDKTRYLGKGVSKAVEHVNKTIAPALISKNVNVVEQEKIDKLMLEMDGTENKSKFGANAILGVSLAVCKAGAAEKGVPLYRHIADLAGNPEVILPVPAFNVINGGSHAGNKLAMQEFMILPVGADNFKEAMRIGAEVYHNLKNVIKEKYGKDATNVGDEGGFAPNILENKEALELLKTAIGKAGYSDKVVIGMDVAASEFYRDGKYDLDFKSPDDPSRYISPDQLADLYKGFVKNYPLVSIEDPFDQDDWAAWKKFTASVGIQVVGDDLTVTNPKRIAKAVEEKSCNCLLLKVNQIGSVTESLQACKLAQSNGWGVMVSHRSGETEDTFIADLVVGLCTGQIKTGAPCRSERLAKYNQLLRIEEELGSKARFAGRNFRNPRIN

SEQ ID NO: 2422 - protein, 766 aa, Meleagris gallopavo
PQRIYYLSLEFYMGRTLQNTMVNLGLQNACDEAIYQLGLDLEELEEIEEDAGLGNGGLGRLAACFLDSMATLGLAAYGYGIRYEFGIFNQKIVDGWQVEEADDWLRYGNPWEKARPEYMLPVHFYGRVEHSPEGVKWVDTQVVLAMPYDTPVPGYKNNTVNTMRLWSAKAPNDFNLQEFNVGDYIEAVLDRNLAENISRVLYPNDNFFEGKELRLKQEYFVVAATLQDIIRRFNSSNFGISSPGAATSEPSKSVLQVAIQLNDTHPALSIPELMRILVDVEKVDWDKAWEITKQTCAYTNHTVLPEALERWPVSMFEKLLPRHLEIIYALNQMHLDRVAALYPGDIDRLRRMSVIEEGDCKRINMAHLCVIGSHAVNGVARIHSDIVKNTVFKDFYELDPEKFQNKTNGITPRRWLLLCNPGLADVIAEKIGEDFVTDLSQLKKLLDFIDDETFIRDVAKVKQENKLKFSAYLEEHYKVKINPSSMFDIQVKRIHEYKRQLLNCLHAITLYNRMRSDPSKSFVPRTIMIGGKAAPGYHMAKMIIKLITSIGEVVNNDPYVGDKLKVIFLENYRVSLAEKVIPAADLSQQISTAGTEASGTGNMKFMLNGALTIGTMDGANVEMAEEAGEENLFIFGMRVEEVEALDRQGYNAREYYDRIPELRQAIDQISSGFFSPRDPGCFRDVVNMLMHHDRFKVFADYEAYIKCQGQVDQLFMDPREWTKKVIRNIACSGKFSSDRTITEYAREIWGVEPSATKIPPPNLPRD

SEQ ID NO: 2423 - protein, 956 aa, Meleagris gallopavo
  MOD_RES (778)..(778): Any amino acid
MENAHTKTVEEVLAYFGVNESTGLSLEQVKKLKEKWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKARDIVPGDIVEVAVGDKVPADIRITSIKSTTLRVDQSILTGESVSVIKHTDPVPDPRAVNQDKKNMLFSGTNIAAGKAMGVVIATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDKVEGDSCSLNEFTVTGSTYAPMGEVHKDDKLIKCSQYDGLVELATICALCNDSSLDYNEAKGVYEKVGEATETALTCLVEKMNVFDTDLKGLSRIERANACNSVIKQLMKKEFTLEFSRDRKSMSVYCTPNKPSRTSMSKMFVKGAPEGVIDRCTHVRVGNAKIPLSSGIKQKIMSVIREWGTGRDTLRCLALATHDNPPRKEEMNLEDSSNFINYETNLTFVGCVGMLDPPRIEVASSIKLCKQAGIRVIMITGDNKGTAVAICRRIGIFVEDEDVSTKAFTGREFDELSLAAQRDACHHARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVVSLTWXAFSMRHCCVSCISVLAGFILESFLNTADFLSLFYILKVKLSCFIVTLSFQSHFLQCKDDNPDFSGVDCVVFESPYPMTMALSVLVTIEMCNALNSLSENQSLMRMPPWENIWLVGAICLSMSLHFLILYVEPLPIIFQITPLNVTQWLMVLKISLPVILLDETLKYVARNYLEPAILE

SEQ ID NO: 2424 - protein, 1536 aa, Meleagris gallopavo
APRSPERRLLLMHLNEMEKLDKTLFRLEQGFELQFRLGPTLQGKHVTVCTNYPASGDVFDRHKFRTLSWHNPTGKEDDSDKYCKLDLQISGSYQYYFSLGNEKSGGGYIVVDPILRVGADNHVLPLDCVTLQTFLAKCLGPFHEWENRLKVAKETGYNMIHFTPLQKLGLSRSCYSLADQLEVNPEFSSHNKKCTWNDIGALVEKMKNEWNMLCITDVVYNHTEAANSEWLRMHPECGYNLVNSPHLKPAWVLDRALWHLSCMVADGRCIDKGVPPMIENDHHLNCIRKIIWEDIYPKIKLWEFFQVDVNKAVQQFRTLLTKGKGKIGTKSDPNQHLQIVQDPDYRRFGCTVDMNIALATFIPHSNGPGAIEECCNWFRKRIEELNAEQYRQIHHHQEQAVNCLAGTVVYERLAGHGPKLGPISRKYPLVTRYFTYPFKDLTVEEEQSMMHQPDKACYFMAHNGWVMGDDPLRNFAEPGSNVYLRRELICWGDSVKLRYGNKPEDCPYLWAHMKKYTEITAKHFHGIRLDNCHSTPIHVAEYMLDTARKLRADLLVVAELFTGNEELDNIFVNSLGITSLIREAMTAYNSHEEGRLVYRFGGEPVGSFVQPRLRPLVPGIAHALFMDITHDNECPIQHRSAYDALPSAMIVSMACCATGSTKGYDELVPHQISVVSEERFYSTWNPQAHLNSGEVNFQTGILAGRLAMNRLHQELGTKGFNQVYVDQVDEDIVAVTRHCPNTHQSVVAVSRTAFRDPKTSFYSKEVPEMCIPGKIEEVVFEARTIERSTSPYKKDEHFINGLPNFTVELREHIQIKESKIIKQAGTAIKGPNEFVQEIEFENLTPGSVIVFRVSLDPKAQEAVGVLRNHLIQFSPHFKSGSLPDDHSAPILKTLFSSIASKLTLADLNQVLYRCESEEQEDGGGCYNIPNWSSLKYAGLQGLMSVMADVRPKNDLGHPFCDNLRSGDWMIDYVSNRLISRAGACAEVGKWLKAMFVYLKKIPRYLIPCYFDAILVGAYTTLLDVGWHQMSSFVQNGSTFVKHLSLGSIQMCGIGKYACLPDLSPSLHDVPYRLNEITNKKEQCCVTLAAGLPHFSSGIFRSWGRDTFIALRGLMLLTGRYIEARNIILAFGGTLRHGLIPNLLGQGTHARYNCRDAVWWWLQCIQDYCKIVPNGLDILRCPVSRMYPRDDSSPQPAGSVDQPLYEVIQEAMQRHMEGISFRERNAGPQIDQNMRDEGFNIIAGVDHETGFVFGGNRFNCGTWMDKMGESDRARNKGIPATPRDGSAVEIVGLCKSAVRWLLDLSRKNEYPFHGVTIKRYGREETITYDEWNRKIQGHFERLFFVSENPADQNEKHPNLVHKRGIYKDSYGASSPWCDYQLRPNFTIAMVVAPELFTPERAWKALRIAEEKLLGPLGMKTLDPDDMVYCGVYDNALDNDNYNVARGFNYHQGPEWLWPIGYFLRAKLYFSKLIGPEIYAKTVVMIKNVLSRHYVHLESRSSWKGLPELTNENGQYCPFSCETQAWSIGVILEVLYDL

SEQ ID NO: 2425 - protein, 262 aa, Meleagris gallopavo
MAQSVWGYDRENGPEHWHENYPMAKGDKQSPIEINSKDVRHDSSLSSWHASYDPGAAKTILNNGRTCRVVFDDSFDRSVLRGGPLTGAYRLRQLHLHWGSADDHGSEHVIDGVKYAAELHLVHWNPKHGNFAGALKQPDGVAVVGVFLKVGKTPKPEMKRILEEIDNIKTKGKEAPFQHFDPSILFPKSRDYWTYHGSFTTPPCEECITWILLREPIEVSPDQMARLRSLSKNGENEPMCPLVDNWRPLQPVKGRIVRASFK

SEQ ID NO: 2426 - protein, 1172 aa, Meleagris gallopavo
MPEPTKKDETETENALPPPEQKTPQDGGTEKGKDEDDTSVSTPPADGMSKAAERKDSVWSIGESPPEETEKHDDSQRSTLFIEKPQSGSVSVGGNITFIAKVEAKDLLRKPNVKWFKGKWMDLASKAGKHLQLKESFERHTKIHTFEMHIIQAKENYAGNYRCEVSYKDKFDSCSFDLEVTESSQAAPSIDIRSAFKRSNSGDGQDDAGELDFSGLLKRREIKQQEEEPEVDVWELLKNANPSEYEKIAFQYGITDLRGMLKRLKRMRREVKKSAAFSKGLDPAYQVDKGGKVRFMVELADPTVELKWYKNGQEIRPSAKYIFEHKGNQRILFINNCTMTDDARYYVTAGDEKCSTELFVRDPPILVTKGLEDTNTYVGERVELSCEVSEDDANVKWFKNGVELTNEPKSRYRIKVEGKKHTLIIEEAAKNDNATYSVMTTGGQSEAKLSVDLRPLKISLALEDQTVRLGQEIHLKCEISENVEGKWYKNGQLIEASDRVKLYHKGRIHRFIIASAAVDDEGEYMFVPDAYNINIPCKVHVVDPPKLHLDGLGENNTVTVVAGTKLRLEIPITGEPTPKVMWSKGDKSGEDMEGNSGRIRAETYSDSSCLVIDTAEREDSGPFRITLKNEAGEDSALINIKVVDVPDPPQAPNVTEVGEDWCVMTWEPPANDGGSPILGYFIERKKKQSSRWMRLNFELCKETTFEPKKMIEGVAYEVRVFAVNAIGTSKPSMPSKSFVPLAVTSPPTLLAVDSVTDTSVTMKWRPPDHIGAAGLDGYVVEYCFEGTDEWIVANPELTDKTKFTINGLPTGSKILVRVKAVNAAGESEPRYHPQPILVKEVIEPPKIRLPRHLKQTYTRRVGETVNLVIPFQGRPRAKVSWQKNGSPIDKNQINIRNTENDTIIFIRKAERSHSGEYDMKVEVENLVDKATIDIQIVDRPGPPEVVTIEDVWGENVNLSWKPPKDDGNAAITGYTIQKADKKSMEWFTVIEHYHRTSATINELVIGNEYYFRVFSENMCGLSEDATMTKESALIAKDGKVYKYPVYDDFDFTERPLFTQPLVNTFAVAGYNATLNCSVRGNPKPKITWLKNKVAILNDPRYRMFGNQGVCTLEIRKPSPYDGGTYTCRAVNELGEAEVDCKLEVKVIYQGVINPGEPIFMAGNNSQLQNKDF

SEQ ID NO: 2427 - protein, 3135 aa, Meleagris gallopavo
  MOD_RES (2614)..(2614): Any amino acid
MRKHRHLPLAAILGLLLSGFCSVGAQQQAAVRNVAVADIIFLVDSSWNIGKEHFQLVREFLYDVVKALDVGGNDFRFALVQFSGNPHTEFQLNTYPSNQDVLSHIANMPYMGGGSKTGKGLEYLIENHLTKAAGSRASEGVPQVIIVLTDGQSQDDVALPSSVLKSAHVNMIAVGVQDAVEGELKEIASRPFDTHLFNIENFTALHGIVGDLVASVRTSMTPEKAGAKGLVKDITAQESADLIFLIDGSNNIGSVNFQAIRDFLVNLIESLRVGAQQIHIGVVQYSDQPRTEFALNSYSTKADVLDAVKALSFRGGKEANTGAALEYVVENLFTQAGGSRIEEAVPQILVLISGGESSDDIREGLLAVKQASIFSFSIGVLNADSAELQQIATDGSFAFTALDIRNLAALRELLLPNIVGVAQRLILLEAPTIVTEVIEVNKKDIVFLIDGSTALGTGPFNSIRDFVAKIVQRLEVGPDLIQVAVAQYADTVRPEFYFNTHQNRKDVMANVKKMKLMGGTALNTGSALDFVRNNFFTSAAGCRMEEGVLPMLVLITGGKSMDAVEQAAAEMKRNRIVILAVGSRNADMAELQEIAHERDFVFNPNDFRLQFMQAILPEVLSPIRTLSGGMIIHETPSVQVTKRDIIFLLDGSLNVGNANFPFVRDFVVTLVNNLDVGTDKIRVGLVQFSDTPKTEFSLYSYQTKSDIIQRLGQLRPKGGSVLNTGSALNFVLSNHFTEAGGSRINEQVPQVLVLVTAGRSADPFLQVSNDLARAGVLTFAVGVRNADKAELEQIAFNPRMVYFVDDFSGLTALPQELNKPITTYVSGGVEEVPLAPTESKKDILFLIDGSANLLGSFPAVRDFIHRVISDLNVGPDATRVAVAQFSDNIQVEFDFAELPSKQDMLLKVKRMRLKTGKQLNIGVALDEAVRRLFVKEAGSRIEEGIPQFLVLLAAGKSNDEVERPSGALKEAGVVTFAIKAKNADLSELERIAYAPQFILNVESLPRISELQANIVNLLKTIQFQPTVVERGEKKDVVFLIDGSDGVRRGFPLLKTFVERVVESLDIGRDKVRVAIVQYSNVIQPEFLLDAYEDKADLVSAIQALTIMGGSPLNTGAALDYLIKNVFTVSSGSRIAEGVPQFLILLTADRSQDDVRRPSVVLKTSGTVPFGIGIGNADLTELQTISFLPDFAISVPDFSQLDSVQQAVSNRVIRLTKKEIESLAPDLVFTSPSPAGAKRDIVFLVDGSRYAAQEFYLIRDLIERIVNNLDVGFDTTRVSVVQFSEHPHVEFLLNAHSTKDEVQGAVRRLRPRGGQQVNMGEALEFVAKTIFTRPSGSRIEEGVPQFLVILSSRKSDDDLEFPSVQVKQVGVAPLVIAKNMDPEEMVQISLSPDYVFQVSSFQELPSLEQKLLAPIETLSADQIRQLLGDVTVPDVSGEEKDVVFLIDSSDSVRTDGLAHIRDFISRIVQQLDVGPNKVRIGVVQFSNNVFPEFFLKTHKSKNAVLQAIRRLRLRGGYPVNAGKALDYVVKNYFIKSAGSRIEDGVPQHLVVILGDQSQDDVNRPANVISSTSIQPLGVGARNVDRNQLQVITNDPGRVLVVQDFTGLPTLERRVQNILEELPVPTTESPGYPGPGGKKQADIVFLLDGSINLGRDNFQEVLQFVYSIVDAIYEDGDSIQVGLAQYNSDVTDEFFLKDYSTKPQILDAINKVIYKGGRVANTGAAIRHLQAKHFVKEAGSRIDQRVPQIAFIITGGKSSDDGQGASMEVAQKGVKVFAVGVRNIDLEEVSKLASESATSFRVSTAQELSELNEQVLVTLAAAMEEKLCPGTTDVTRDCDLDVILGFDVSDVGAGQNIFNSQRGLESRVEAVLNRITQMQKISCTGSQAPNVRVAIMAQSRGGPVEGLDFSEYQPELFERFQGMRTRGPYFLTAETLKSYQNKFRSAPSGSTKVVIHFTDGTDDSLDQMKTASADLRRQGVHALLFVGLDRVKNFEEVMQLEFGRGFTYNRPLRVNLLDLDFELAEQLDNIAERTCCGVHCKCSGQRGDRGLPGPIGPKGATGDIGYGGYPGDEGGPGERGPPGVNGTQGFQGCPGHRGTKGSRGFPGEKGELGEMGLDGIDGEEGDKGLPGSSGEKGFSGRRGNKGAKGERGERGDRGLRGDPGDSGADNTQRGTRGQKGEIGQMGEPGPAGQRGPDGGVGRQGMAGRRGPIGVKGTKGALGQPGPAGEQGMRGPQGPPGQIGTPGIRGEQGVPGPRAGGGQPGAPGERGRIGPLGRKGEPGNPGPKGPNGQQGPRGEMGDDGRDGIGGPGPKGRKGERGFIGYSGPKGGPGDRGGAGGPGPKGNRGRRGDAGNPGTPGQKGEIGYPGPSGLKGEKGPSISQCALVQNIKDKCPCCYGPKECPVFPTELAFAIDTSSGVGRDVFNRMKQTVLRVVSNLTIAESNCPRGARVALVTYNNEVTTEIRFADARKKSSLLQQIQNFQATLTTKPRSLETAMSFVARNTFKRARSGFLMRKVAVFFSNGETRASPQLNDAVLKLYDAGVTPVFLTSRQDAVLERALEINNTAVGHAIVLPTSGSQLNDTIRRLLTCHICLDVCEPDPICGYGSQRPVFRDXAAPTDVDTDMAFIMDSSASTTPLQFNEMKKYISHLISNMEISSEPKISQHHARVAVLQQAPYEHETNSSFPPVKTEFSLTDYGSKQKIINYLHNQMTQLYGTMAMGSAVEHTVAHIFESAPNPRDLKVIVLMITGKMEKQELEDLREAVIDAKCKGYLFVILGIGRNVDVKNIYSLASEPNDVFFKLVSKPGELHEEPLLRFGRLLPSFIRSDFAFYLSPEIRKQCKWLQGDQTPKSPGHTGQKAVYVAPNATITQTISTTTTLSTTIKPAASTSAHAKTTTASTTAQTRATERPTESTTVQVNATVQGQGSTAANTKATSRTTASTTAAAASGRRRQGAKMNDIQITDVTENSARLRWASPEPHSAYVFDLTITLAHDHSLVLKQNVTGSERVIGGLRSGQKYLVFITGYLKSQPKVTYTGTFSTKTPAQPKVALANMMLNTEPLEGPENVMDICLLQKEEGTCRDFVLKWHYDVKTKSCARFWYGGCGGNENRFNTQKECEKACSPGNISPGVVTTIGT

SEQ ID NO: 2428 - protein, 759 aa, Meleagris gallopavo
  MOD_RES (728)..(728): Any amino acid
PYSLLFLLAEIDEATRSFAEKVFASEVKDEATRQEISPFDVEEICPISRHEMRTHMMLQESSSAAEKRQRRKKKKPFCPVTSALSLQWPQVSWRWRPGDLYGKKTGLSTIDEIISTSPQYQSVPDFQRVQITGDYASGVTVEDFEVVCKGLYRALCIREKYMQKSLQRFPRTPSQYLRTIEGEVWRASDAGPVFTPPVKDGQDPFETGNLPEDLGYHVQMKDGIVYIYSDKAAAGRNEPKDLPYPNLKHFVDDMNFLLALIAQGPVKTYSHRRLKFLSYKFQVHEMLNEMEEMKELKNNPHRDFYNCRKVDTHIHAAACMNQKHLLRFIKKSYRVDADRVVYDAKGEKLTLKQLFQKLNLHPYDLTVDSLDVHAGRQTFQRFDKFNAKYNPVGASELRDLYLKTENTINGEYFATIIKEVGSDLEDAKYQHAEPRLSIYGRSAEEWPKLANWFNRHRVYSPNMKWMIQVPRIYDVFRSRNFLPHFGKMLENIFVPVFEATVNPQAHKELSVFLRHITGFDSVDDESKHSGHMFSTKSPKPEQWTSAKNPSYTYYVYYMYANILVLNNLRRQRGMNTFLFRPHCGEAGAITHLLAAFMTADNISHGLNLKKSPVLQYLYFLAQIPIAMSPLSNNSLFLEYAKNPLLDFHQKGLMVSLSTDDPMQFHYTKEPLMEEYAIAAQVFKLSTCDMCEIARNSVLQCGLSHEEKAKFLGEKYQEEGPHGNDVRKXALRAARKESLGGEGSDILDTAGQEEYSAMRD

SEQ ID NO: 2429 - protein, 366 aa, Meleagris gallopavo
STMTHQYPALTAEQKKELSDIALRIVAPGKGILAADESVGSMAKRLNQIGVENTEENRRLYRQILFSADSRVKKCIGGVIFFHETMYQKADDGTPFVQMIKDKGIVVGIKVDKGVVPLAGTDGETTTQGLDGLSERCAQYKKDGADFAKWRCVLKISDNTPSALAIMENANVLARYASICQQNGIVPIVEPEILPDGDHDLKRCQYVTEKVLAAVYKALSDHHVYLEGTLLKPNMVTPGHSCPTKYSPEEIAMATVTALRRTVPPAVPGVTFLSGGQSEEEASINLNAINTCPLVRPWALTFSYGRALQASALSAWRGQRDNANAATEEFVKRAEVNGLAALGKYEGSGDDSGAAGQSLYVANHAY

SEQ ID NO: 2430 - protein, 337 aa, Meleagris gallopavo
MLSRFARPAAVLCRGLATSAQNNAKVAVLGASGGIGQPLSLLLKNSPLVSRLSLYDIAHTPGVAADLSHIETRANVKGFLGPEQLPECLKGCDVVVIPAGVPRKPGMTRDDLFNTNASIVATLTTACAKHCPEAMICIISNPVNSTIPITSEIFKKHGVYNPNRIFGVTTLDIVRANTFVAELKGLDPARVSVPVIGGHAGKTIIPLISQCTPKVDFPQDQLEKLTGRIQEAGTEVVKAKAGAGSATLSMAYAGARFVFSLVDAMNGKEGVIECSFVRSEETESPYFSTPLLLGKNGIEKNLGIGKITPFEEKMVAEAMAELKASIKKGEDFAKNFK

SEQ ID NO: 2431 - protein, 655 aa, Meleagris gallopavo
GGPGEEGEAGPEPGTQHGSQEEEEEEEANTKEVASEGKEPTVSAPEGGEEEDEQSSEEDDEQGESEEDEGEAESEEEGKSAEEGESEEDGASPEGLEDGAEGTDTEETSGENDHGKAAAGHEGEQSSPGEPSNSRRPSNSRRPTGSSGRPPGRQGTISRNGEPSQPQCLQSSPSSLGTQTAELLKRCPGCGQGVSDQPKAASSEEVEDASEPTKRDRSHLENTLKLNEDKPADDFSGVLQRLRKIYHSSIKPLEQSYRYNELRQHEITDGEITSKPMVLFLGPWSVGKSSMINYLLGLDDTPYQLYTGAEPTTSEFTVIMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADSLATQELMRVYGALFWSLAPLINVTEPPRVYVSSFWPHEYHPDTHKDLFLKEEISLLEDLNQVIENRMENKIAFIRQHAIRVRIHALLVDRYLQTYKDKMTFFSDGELVFRDIVEDPDKFFIFKSILAKTNVSKFDLPNREAYKDFFGINPITGFKLLSQQCSYMGGCYLEKIEKAITRELPDLLGSIGLGKKPNVLSCDITGCGETPKNRYKKP

SEQ ID NO: 2432 - protein, 1008 aa, Meleagris gallopavo
WNPTELPAEEGKSLWELVLEQFEDLLVRILLMAAFLSFILAWFEEGEESTTAFVEPIVIIMILIANAVVGVWQERNAESAIEALKEYEPEMGKVIRADRSGVQRIRARDIVPGDIVEVAVGDKVPADVRIIEIRSTTLRVDQSILTAGESMSVIKHADPIPDPRAVNQDKKNMLFSGTNIAAGKAVGIVIATGVYTEIGKIRNQMVETEPEKTPLQQKLDEFSQQLSKVIFLVCIAVWVINISHFSDPVHGGSWFRGAIYYFKTSVALAVAAIPEGLPAVITTCLALGTRRMAKKNAIVRSLPSVETLGCTSVICSDKTGTLTTNQMSVCRMFIMEKVEGTQCSLHEFSITGSTYAPEGEILKDKQLVKCGQYDGLVELATICALCNDSSLDYNESKKVYEKVGEATETALTCLVEKMNVFNTDTSKLSKVERANACNSVIKHLMRKECTLEFSRDRKSMSVYCTPTGPGHNSTGSKMFVKGAPESVIERCTHVRVGTAKVPLTTPVREKILSQIRDWGMGVDTLRCLALATHDAPVHRETMQLHDSTTFAHYETNLTFVGCVGMLDPPRKEVASSIEMCRKAGIRVIMITGDNKGTAVAICRRIGIFTETEDVAGKAYTGREFDELSPEAQRQACREARCFARVEPAHKSRIVEYLQSFNEITAMTGDGVNDAPALKKAEIGIAMGSGTAVAKSAAEMVLSDDNFSTIVSAVEEGRAIYNNMKQFIRYLISSNVGEVVCIFLTAILGLPEALIPVQLLWVNLVTDGLPATALGFNPPDLDIMDKLPRNPKEPLISGWLFFRYLAIGVYVGLATVGAATWWFLYDTEGPQVSFHQLRNFMRCTEDNPIFEGVDCEIFESRYPTTMALSVLVTIEMCNALNSVSENQSLLRMPPWLNIWLLGAIVMSMALHFFILYVKPMPLIFQVTPLSWPQWVVVLKISLPVILLDEGLKYLSRNHLEGILRTVRNTWSGEHQLKTCRTPEQGRRGQEMNDTKETLQAKGPQTCNSD

SEQ ID NO: 2433 - protein, 1247 aa, Meleagris gallopavo
LVKPPQKSSIRGVHITQFVDKIPKGCSTPDFERKPVSLTLQEGKNAIFRAVVKGVPAPEVKWKRAKGEINDPAKYLMFYSPATSEHILQINKITAGDSDLYRCFAVNEYGEASCSAGLRIIQVGFKRKANYVTGHPAEELKKSLQDLKKTLKKRAPLPKQKEVDKEAIFQLLLHADKKDYERICIKYGISDFRGMLRALQDLRKDTENEQAKLIHSIKHMEHIKVNKDGSASFSVEMDLKSASSNVYLLKDGEKVRYGTGDEYRKYYLRQIGKRYHFIVNDVHPEDAGLYQVRVEDVPIFSTELDAESIPVRFQKPLTDLRCHEKEDVVFDCVLRTPCFDAVWLHKAHPLEASEKHQISVSPDGLIHQLIIKNAATSDNGLYTLDTGLCSSRAWLLVEHAKEAKIQDEEHEKSDHQKGAPDKDRDAGMKRDGWYRSDQGVSQGYSTDADGEYGRHDSTLGAVDVDMGDAEVITCCEVPRCHPGAWTKFSIKLTSMDGVSLEKEGLVHKLVISKVEDIHAGKYRFEAGDIKTEASIFVEDPPQVDEILLKNLTSVPTVAKAGEKVVIKIPFEGRLPVRAMWLKDKIELGDDSRIRVDKTDTFTMLSISSAERKDCGDYKVRLKNDSGILDIDLKVEVTDKPLPPAGPLKIVGSTANDVTIQWNPPKDDGGKPVQNYIIEKQQVGKSGWVTLGETPRSCTTFTTSKVEQDMSYYFRVRAVNAEGTSDALESDEVVTISKATPGAPDPPEIIGVSKDTITISWKTPRKTGSSRILGYIVQKRKKGSMTWVPVNSVPIADKKLKINDLKKGVQYEFCVAAVNASGIGDISAPSQAAFARDSTKPPGKVRDLKMTISDSSSVTLTWNVPEAKEGSGAKGYNVEIRSSNNLSWTKCNIFPIETTTYKVKGLKTKETYFVRVRAINDCGPGEATELEAFTEAVPPVVSPRFIIDKTVKNFLVIKAGNAIRVNIPFEAPPDSVLTWLKDGVPLPSRAKISTQDGTSQLLIKAAEFTDSGIYTVELVSGTGKRETFSFQVQVTDIPQPPGPIELIENVPNIVTVTWEPSTSEKWESNLFYTVFKRESQKGLWHVVGDLIYTNKFTYTKVIPGRDYYFRVVAKNHLGSSRPSDTVQPWRIRKQKADIQVRPQRYKGVNQNQPPRFLVPLKPHVVITGSECRMSCAVGGHPPPKITWYKDGRDLSNNPSYFGTNNFGVCSLVIFSVSKADEGDYTVEATNDSGRAFSKASLTIKDSCL

SEQ ID NO: 2434 - protein, 431 aa, Meleagris gallopavo
IDKRTIEKFEKEAAEMGKGSFKYAWVLDKLKAERERGITIDISLWKFETTKYYITIIDAPGHRDFIKNMITGTSQADCAVLIVAAGVGEFEAGISKNNGQTREHALLAYTLGVKQLIVGINKMDSTEPAYSEKRYDEIVKEVSAYIKKIGYNPATVPFVPISGWHGDNMLEPSPNMPWFKGWKVERKEGNASGVSLLEALDTILPPTRPTDKPLRLPLQDVYKIGGIGTVPVGRVETGILRPGMVVTFAPVNITTEVKSVEMHHEALSEALPGDNVGFNVKNVSVKDIRRGNVCGDSKSDPPQEAAQFTSQVIILNHPGQISAGYSPVIDCHTAHIACKFAELKEKIDRRSGKKLEDNPKSLKSGDAAIVEMIPGKPMCVESFSQYPPLGRFAVRDMRQTVAVGVIKNVEKKSGGAGKVTKSAQKAQKAGK

SEQ ID NO: 2435 - protein, 434 aa, Meleagris gallopavo
MAVERIHAREILDSRGNPTVEVDLYTHKGMFRAAVPSGASTGIYEALELRDNDKSRFLGKGVLQAVDHINSTVAPAIVGSGLSVVDQEKIDNLMLEMDGTENKSKFGANAILGVSLAVCKAGAAEKDVPLYRHIADLAGNSDLILPVPAFNVINGGSHAGNKLAMQEFMILPVGAESFRDAMRIGAEVYHNLKSVIKEKYGKDATNVGDEGGFAPNILENSEALELLKEAIDKAGYTDKIVIGMDVAASEFYRDGKYDLDFKSPDDPSRYISADELGDLYQSFVRDYPVVSIEDPFDQDDWEAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 2436 - protein, 508 aa, Meleagris gallopavo
LMRIFVDIEKLPWSKAWDITKRTFAYTNHTVLPEALERWPVDLVEKLLPRHLEIIYEINQRHLDHIASLFPDDVDRLRRMSLIEEGGTKRINMAHLCIVGSHAVNGVAKIHSEIIKSEVFRDFAELEPDKGMGGSARGSQPWGPSVLCGQHVAVLLSQKIGEDYVRDLSQLAKLHEFVDDDLFIREVAKVKQENKVKFALYLEKEYGVKINPSSMFDVHVKRIHEYKRQLMNCLHIITMYNRIKRDPAKLFVPRTVIIGGKAAPGYHMAKMIIKLINAVAQVVNNDPVVGSKLKVIFLENYRVSLAEKVIPATDLSEQISTAGTEASGTGNMKFMLNGALTIGTMDGANVEMAEEAGEENLFIFGMRVEDVVELDKDGYNAQQYYDRLPELKQAVDQIRSGFFSSDEPDLFRDVVDMLFHHDRFKVFADYEAYVKCQEKVSELYLNSKAWTKMVIRNIAAAGKFSSDRTIKEYARDIWHVEPSDLKIPPPNEPRGAEDRTPNGTAARA

SEQ ID NO: 2437 - protein, 142 aa, Meleagris gallopavo
MVLSAADKNNVKGIFTKIAGHAEEYGAETLERMFITYPPTKTYFPHFDLSHGSAQIKGHGKKVVAALIEAVNHIDDIAGTLSKLSDLHAHKLRVDPVNFKLLGQCFLVVVAIHHPAALTPEVHASLDKFLCAVGTVLTAKYR

SEQ ID NO: 2438 - protein, 178 aa, Meleagris gallopavo
KKRRAATARRQHLKSAMLQLAATEIEKEAAAKEVEKQNYLAEHCPPLSLPGSMQELQELCKKLHAKIDSVDEERYDTEVKLQKTNKELEDLSQKLFDLRGKFKRPPLRRVRMSADAMLRALLGSKHKVNMDLRANLKQVKKEDTEKEKDLRDVGDWRKNIEEKSGMEGRKKMFEAGES

SEQ ID NO: 2439 - protein, 298 aa, Meleagris gallopavo
VYPLPPAGPSSYSVGTMSERFDCYYCRDSLQGKKYVQKEGRHCCVKCFEKICANTCIECKKPIGADSKELHFKNRYWHDSCFRCVKCYTSLVNEPFMLRENNKVWCSNCTATEDAPRCKGCFKPIIAGDQNVEYKKMVWHKDCFTCSQCKQVIGSGSFFPKGDEFYCVSCHEHKFAKTCAKCKNPITSGGLTYQEQPWHSECFICSNCKRQLGGKRFTAVEDQFYCVDCYKECVAKKCAGCKNPITAGFGRGTSVVNYEDESWHDYCFKCTKCARGLANKRFVCHNGKIYCAECPKRL

SEQ ID NO: 2440 - protein, 634 aa, Meleagris gallopavo
MSGKGPAIGIDLGTTYSCVGVFQHGKVEIIANDQGNRTTPSYVAFTDTERLIGDAAKNQVAMNPTNTIFDAKRLIGRKYDDPTVQSDMKHWPFRVVNESGKPKVQVEYKGEMKTFFPEEISSMVLTKMKEIAEAYLGKKVQNAVITVPAYFNDSQRQATKDAGTITGLNVMRIINEPTAAAIAYGLDKKGTRAGEKNVLIFDLGGGTFDVSILTIEDGIFEVKSTAGDTHLGGEDFDNRMVNHFVEEFKRKHKRDIAGNKRAVRRLRTACERAKRTLSSSTQASIEIDSLFEGIDFYTSITRARFEELNADLFRGTLEPVEKALRDAKLDKGQIQEIVLVGGSTRIPKIQKLLQDFFNGKELNKSINPDEAVAYGAAVQAAILMGDKSENVQDLLLLDVTPLSLGIETAGGVMTALIKRNTTIPTKQTQTFTTYSDNQSSVLVQVYEGERAMTKDNNLLGKFDLTGIPPAPRGVPQIEVTFDIDANGILNVSAVDKSTGKENKITITNDKGRLSKDDIDRMVQEAEKYKAEDEANRDRVGAKNSLESYTYNMKQTVEDDKLKGKISDQDKQKVLDKCREVISWLDRNQMAEKEEYEHKQKELEKLCNPIVTKLYQGAGGAGAGGSGGPTIEEVD

SEQ ID NO: 2441 - protein, 1021 aa, Meleagris gallopavo
KSRLRRRREREITEITSEEEEEIEMVQHVHREFSPPSRLLRRRRSLSPTYIELMRPVSELIRPRSRPPEESERRSPTPERTRPRSPSPVSTERSLSRFERMARFDIFSRYESMKSALKTQKTMERKYEVLTQQPFTLDHAPRITLRMRSHRVPCGHNTRFILNVQSKPTADVKWYHNGIELQESSKIHFSNTSGVLTLEILDCHIDDSGTYRAVCTNYKGECSDYATLDVTGGDYTTYSSQRRDEEVPRSILPDLTRTEAYAVSSFKKASATEASSSVREVKSEVSATRESLLSYEHHASSEEKTTASEEKSLEERTVRKAFKSTLPATILTKPRSITVSEGETARFSCDVDGEPAPTITWVRAGQPIVSSRRFQITRTQYKSTFEISLVQISDEGSYTVVVENSEGRQEAHFTLTVQRKRIPEKAITSPPRIKSPEPRVKSPEPVKSPKRVKSPEPISTHPKAKSPPGDKTAPVEKVQLPTASPPKIKEQLKAETLGDKVKLSCAVESSALSVREVAWYKDGKKLKEDHHFKFHYAADGTYELKIHDLTESDKGEYTCEIMGEGGISKTNFQFTGQVFKNIHSQVRSVSETHKLVEKGDEVLTVSTQKKSSVAAEEKSAVEEVIKKSIVTEDVKQLKTEIRASSTQMTMSEGQKVTLKANIPGASEVKWVLNGMELRNSDDYRYGISGSDHTLTIKKASNKDEGILTCEGKTDEGVIKCQYVLTFSKERSNEPAFIMQPKSQNVNEGQDVLFTCEVSGDPSPEIEWLRNNQPIAVSSHMRVTRSKNTYSLEIRNAAVSDTGKYTVKAKNYHGQCSATASLTVFPLIEEPPKEVVLKTSGDASMHESFSSQSFQMAASKQEASFSSFSSSSMTETKFASMSAKSMSSMKESFVEMSSSSIMGKSSMAQLESSTSKMLKSGVRGVPPKIEALPSDISIDEGKVLTLSCAFSGEPAPEITWYCRGRKITSQDQQGRFHIETSEDLTTLIIMDVQKNDGGIYTLNLGNEFGTDSATVNINIRSI

SEQ ID NO: 2442 - protein, 282 aa, Meleagris gallopavo
AIPPSYADLGKSARDIFNKGYGFGLVKLDVKTKSASGVEFTTSGSSNTDTGKVNGSLETKYKWAEYGLTFTEKWNTDNTLGTEIAIEDQIAKGLKLTFDTTFSPNTGKKSGKIKSAYKRECLNLGCDVDFDFAGPAIHGSAVFGYEGWLAGYQMTFDSAKSKLTRNNFSVGYKTGDFQLHTNVNDGSEFGGSIYQKVSDNLETAVNLAWTAGSNSTRFGIAAKYKLDSTASISAKVNNSSLVGVGYTQTLRPGVKLTLSALIDGKSINAGGHKLGLGLELEA

SEQ ID NO: 2443 - protein, 293 aa, Meleagris gallopavo
MPLAGTPAPLKRKKPTKLIGKLTHEVMPQEVTKLNLGKKISIPRDVMLEELSLLTNKGSKMFKLRQLRVEKFIYENNPDAFSDNSVDHFQRFIPSGGHYGEDAHGYGHGRMVGGVTAGQHGSSKQHYSTVPPRPGSKGGPGNSEGEHAEKSAGSAGEGGHGTEKDGKSGGKKPLLKTYISPWERAMGISPEDKSQLTIDLLSYSPKADFPHYKSFNRTAMPYGGYEKAAKRMTFKVPQFDICPLLPESIVLYNQNFRNRPSFNRTPIPWMPSGESSEYHTDINVPRSGETEEL

SEQ ID NO: 2444 - protein, 422 aa, Meleagris gallopavo
SSFRADMLLSARGEGRATPTSCSWWSHVEMGPPDPILGVTEAFKRDTNSKKMNLGVGAYRDDNGKPYVLNCVRKAEAMIASKKMDKEYLPIAGLADFTRASAELALGENSEAFKSGRYVTVQGISGTGSLRIGANFLQRFFKFSRDVYLPKPSWGNHTPIFRDAGLQLQAYRYYDPKTCSLDFTGAMEDISKIPEKSIILLHACAHNPTGVDPRQEQWKELASVVKKRNLLVYFDMAYQGFASGDINRDAWAVRHFIEQGIDVVLSQSYAKNMGLYGERAGAFTVICRDAEEAKRVESQLKILIRPMYSNPPINGARIASLILTTPDLRKEWLVEVKGMADRIISMRTQLVSNLKKEGSSHNWQHITDQIGMFCFTGLKPEQVERLTKEFSIYMTKDGRISVAGVASSNVGYLAHAIHQVTK

SEQ ID NO: 2445 - protein, 539 aa, Meleagris gallopavo
MTGKTAPAAAKKAPASKKAPAPAPKEEPAHTPKEEPAHTPKEGPAHTPKEEPAHTPKEEHAPAPAAETPPAPEHPPDAEQPAAPASEHAPAHEAEATPAHEEGSPPAAPAEAPAPQPEPEKPKEEPPSIPLSLAVEEVTENSVTLTWKAPEQTGKSSLDGYVVEICKDGSTDWTAVNKAPFLSTRYKIQDLGSGEKVHVRVKAISASGTSVPATLEQPILIREITDLPRIRLPRQLRQVYVRHVGEAVNLLIPFQGKPQPQVTWTKDNQPLDTSRVNIRNTDKDTIFFIRTAQRSDSGKYQLAVRINGAEDKAVLDIRVIELPGPPQNLKLVDVWGFNVALEWSPPADNGNSEIKGYTVQKSDKKSGKWFTVLERCTRTSCTISDLIIGNTYSFRVFSENACGLSETAAVASGVAHIKKTKTVYQPQKIPERDMMEPPKFTQPLTDRATTRGYSTHLFCSVRGFPQPKIIWMKNKMEIREDPKYIAMIEQGVCSLEIRKPSPFDAGVYTCKAVNPLGEASVDCKLDVKSKVLVEEELKG

SEQ ID NO: 2446 - protein, 646 aa, Meleagris gallopavo
MSKGPAVGIDLGTTYSCVGVFQHGKVEIIANDQGNRTTPSYVAFTDTERLIGDAAKNQVAMNPTNTVFDAKRLIGRRFDDSVVQSDMKHWPFTVVNDAGRPKVQVEYKGETKSFYPEEISSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKISDEDKQKILDKCNEIINWLDKNQTAEKEEFEHQQKELEKVCNPIITKLYQSAGGMPGGMPGGFPGGGAPPSGGASSGPTIEEVD

SEQ ID NO: 2447 - protein, 185 aa, Meleagris gallopavo
SLGCKNAQYGQILKELMQTPNFRVTVVQEADTVEICGALKNIVAVGAGFCDGLGFGDNTKAAVIRLGLMEMISFAKIFCKGPVTPSTFLESCGVADLITTCYGGRNRKVAEAFAKTGKSIEQLEKEMLNGQKLQGPQTSAELNHILKTKNMVDKFPLFTAVYQICYEGKPVSDVIKCLQNHPEHM

SEQ ID NO: 2448 - protein, 192 aa, Meleagris gallopavo
MAPKKDVKKPAAAAAPAPAPAPAPAPAPAKPKEPAIDLKSIKIEFSKEQQDDFKEAFLLFDKTGDAKITLSQVGDIVRALGQNPTNAEMNKILGNPSKEEMNAKKITFEEFLPMLQAAANNKDQGTYEDFVEGLRVFDKEGNGTVMGAELRHVLATLGEKMTEEEVEELMKGQEDSNGCINYEAFVKHIMSV

SEQ ID NO: 2449 - protein, 351 aa, Meleagris gallopavo
GRGQRELIIGDRQTGKTSIAIDTIINQKRFNDGTDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDSFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLNRGVRLTELLKQGQYVPMAIEEQVAVIYAGVRGHLDKLEPSKITKFESAFLAHVLSQHQALLSTIRTEGKISDQTEAKLKEIVTNFLSTFEA

SEQ ID NO: 2450 - protein, 386 aa, Meleagris gallopavo
KNCWTQRLIGASSRSAEYPDLRKHNNCMASNLTPAIYARLCDKATPNGWTLDQCIQTGVDNPGHPFIKTVGMVAGDEETYEVFAELFDPVIQERHNGYNPRTMKHVTDLDASKIKFGHFDERYVLSSRVRTGRSIRGLSLPPACTRAERREVEKVTVEALNGLTGDLSGRYYRLSEMTEKEQQQLIDGSGMGEQPVAPSPIYRLVLAGDSGAGAPGRGGLPGNEKTFLIWINEEDHTRVISMEKGGNMKRVFERFCRGLKEVERLIQERGWEFMWNERLGYILTCPSNLGTGLRAGVHIKLPLLSKDSRFPKILENLRLQKRGTGGVDTAATGNVFDISNLDRLGKSEVELVQLVIDGVNYLIDCERRLEKGQDIRIPSPVPQFRH

SEQ ID NO: 2451 - protein, 425 aa, Meleagris gallopavo
GENTVRTIAMDGTEGLVRGQKVLDSGAPIRIPVGPETLGRIMNVIGEPIDERGPITTKQFAAIHAEAPEFVEMSVEQEILVTGIKVVDLLAPYAKGGKIGLFGGAGVGKTVLIMELINNVAKAHGGYSVFAGVGERTREGNDLYHEMIESGVINLKDATSKVALVYGQMNEPPGARARVALTGLTVAEYFRDQEGQDVLLFIDNIFRFTQAGSEVSALLGRIPSAVGYQPTLATDMGTMQERITTTRKGSITSVQAIYVPADDLTDPAPATTFAHLDATTVLSRAIAELGIYPAVDPLDSTSRIMDPNIVGPEHYDVARGVQKILQDYKSLQDIIAILGMDELSEEDKLTVARARKIQRFLSQPFQVAEVFTGHMGKLVPLKETIKGFKQILAGEYDHLPEQAFYMVGPIEEAVAKAEKLAEEHA

SEQ ID NO: 2452 - protein, 1087 aa, Meleagris gallopavo
MTTKAPTFTQPLQSVVALEGSAATFEAHISGFPVPEVSWYRDGQVLSAATLPGVQISFSDGRAKLVIPSVTEANSGRYTIQATNGSGQATSTAELLVTAGTAPPNFSQRLQSMTARQGSQVRLDVRVTGIPTPVVKFYRDGVEIQSSPDFQILQEGDLYSLIIAEAYPEDSGTYSVNATNNVGRATSTAELLIQGEEEAVPAKKTKTIVSTAQISQTRQARIEKKIEAHFDARSLTSVEMVIEGATAQQLPHKAPPRMPPRPTSKSPTPPVITAKAQMARQQSPSPVRQSPSPVRHVRAPTPSPVRSVSPAGRISTSPIRPVKSPSPIRKAQVVTPGAEVLPPWRQEGYSATTEAQMKETRVSTSATEVRTEERWEGRYGLQEQVTISGAAAGEVAAGAKEVRRDSEKTAAVATVVAAVDQAMVREPAPSVVEQAAKRTAMTAVHVQPVQEQMRKEATVVVTSDKATKQTVISRTREGIVTSQEQRHISREKVRKEPEKTPVPTVIIATDKAKEQERISTAREEISVRHEQVHVSHEQIRREDVKPSVPKVVITTDKPKAPVLISKSKEGIATKQERVSISHEKIKKEAKKTTVVPKIIAPVTVPRTREEITAKQEQMHLAYDQIEAGKRAEAVATVVAAVDQARVRSPWETEQVDETYVKQKTLEYGYKEHAVKDHEAQAEHRVATKEVKTVYIPPEKHIPAAEKKEVHVSTEIKRETEAKIEKTIHIEHPRPRTASPHFTVSKIAVPKPDHTYEVSIAGSAMATLEKELSAASAAQKITKPVKPPQLKPHEVKIKPESAPPQFPFTEVAETKKEVDVSIKGEAVREDHLLLRKESEAKVTETARVPVPAEIPVTPPTLVWGLKNKTVTEGESVTLECHISGHPQPTVTWYREDYKIESSMDFQITFKAGLARLVIREAFAEDSGRFTCTATNKAGSVSTSCHLHVKVSEETETRETISEKVVTEEKSYVETKDVVMEDVSAAAEEVSGEPVPPFFIRKPVVHKLIEGGSIIFECQVGGNPKPHVLWKKGGVPLTTGYRYKVSYKRETGECKLEISMTFADDAGEYTIVIRNKFGEASATVSLLEE

SEQ ID NO: 2453 - protein, 147 aa, Meleagris gallopavo
MVHWSAEEKQLITGLWGKVNVADCGAEALARLLIVYPWTQRFFASFGNLSSPTAILGNPMVRAHGKKVLTSFGDAVKNLDNIKKSFAQLSKLHCDKLHVDPENFRLLGDILIVVLASHIGKDFTPASQAAWQKMVRVVAHALAHEYH

SEQ ID NO: 2454 - protein, 265 aa, Meleagris gallopavo
LLLQVQHASKQITAEKQYKGIIDCVIRIPKEQGIISFWRGNLANVIRYFPTQALNFAFKDKYKQIFLGGVDRHKQFWRYFAGNLASGGAAGATSLCFVYPLDFARTRLAADVGKGVAEREFTGLGDCIVKIFKSDGLRGLYQGFNVSVQGIIIYRAAYFGVYDTAKGMLPDPKNVHIIVSWMIAQSVTAAAGLVSYPFDTVRRRMMMQSGRKGADIMYKGTIDCWKKIAKDEGSKAFFKGAWSNVLRGMGGAFVLVLYDEIKKYV

SEQ ID NO: 2455 - protein, 374 aa, Meleagris gallopavo
SKGLGAASHPPLTPPPHIFPTSGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 2456 - protein, 716 aa, Meleagris gallopavo
IKQATWLSVSNIIQLGGTVIGSARCKAFTTRQGRLRAAHNLVEHGITNLCVIGGDGSLTGADIFRAEWAGLLDELLRDGLISEEVAKANGRLNVVGLVGSIDNDFCGTDMTIGTDSALHRIMEVIDAITTTAQSHQRTFVLEVMGRHCGYLALVSGLASGADWLFIPESPPEDGWEDLMCERLGETRSRGSRLNIIIIAEGAIDRNGKPISSNYVKDLVVQRLGFDTRVTVLGHVQRGGTPSAFDRVLSSKMGMEAVMALLEATPDTPACVVSLSGNQSVRLPLMECVQVTKDVQKAMDEKRFDEAIQLRGRSFENNWNIYKLLAHQKPAQEKSPFSLAILNVGAPAAGMNAAVRSAVRISICRGHTVYAVSDGFEGLAKGQIREVGWHDVAGWLGRGGSMLGTKRTLPKTCMEKIVENVRKFNIQALLVIGGFEAYEGVLQLVEARGQYEELCIIMCVIPATISNNVPGTDFSLGSDTAVNAAMESCDRIKQSASGTKRRVFIVETMGGYCGYLSTVTGIAVGADAAYVYEDPFTIHDLKANVEHLTDKMKTDIQRGLVLRNEKCHEHYTTEFLYNLYSSEGKGIFDCRINVLGHLQQGGAPTPFDRNYGTKLGVKAVLWMSEKLQEAYRKGRVFANSADSACVIGLRKKVVAFSPVTELKKVTDFEHRLPQEQWWLNLRLMLKMLANYQISLTEYISGKMEHVTRRTLSIEKGF

SEQ ID NO: 2457 - protein, 864 aa, Meleagris gallopavo
KVNFTVDQIRAIMDKKANIRNMSVIAHVDHGKSTLTDSLVCKAGIIASARAGETRFTDTRKDEQERCITIKSTAISLFYELSENDLAFIKQSKDGSGFLINLIDSPGHVDFSSEVTAALRVTDGALVVVDCVSGVCVQTETVLRQAIAERIKPVLMMNKMDRALLELQLDPEELYQTFQRIVENVNVIISTYGEGESGPMGNIMIDPVLGTVGFGSGLHGWAFTLKQFAEMYVAKFAAKGDAQMNPSERAKKVEDMMKKLWGDRYFDPATGKFSKSATGPDGKKLPRTFCQLILDPIFKVFDAIMTFKKEEAAKLIEKLDIKLDSEDKDKEGKPLLKAVMRRWLPAGDALLQMITIHLPSPVTAQKYRCELLYEGPPDDEAAIGIKNCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVMCLSKSPNKHNRLYMKARPFPDGLAEDIDKGEVSARQELKQRARYLAEKYEWDVTEARKIWCFGPDGTGPNILTDITKGVQYLNEIKDSVVAGFQWATKDLPLLTQGVLCEENMRGVRFDVHDVTLHADAIHRGGGQIIPTARRCLYACVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDSTSRPSQVVAETRKRKGLKEGIPALDNFLDKL

SEQ ID NO: 2458 - protein, 1086 aa, Meleagris gallopavo
MASLDDDRTSSAHAFLKFGSIYEPLKSINLPKAEGESLWDKLDHYYRIVKSTLLLHQSPTTGLFPTKTHGDNHKAKVHDNLYCAACSWALALAYRRIDDDKGRTHELEHSAIKCMRGILYCYMRQADKVQQFKQDPKPSGCLHSVFNAHTGDEVFSHNEYGHLQINAVSLFLLYLVEMISSGLQIIYNTDEVSFIQNLVFCVERAYRVPDFGVWERGSKYNNGCPELHSSSVGLAKAALEAINGFNLFGNQGCSWSVIFVDFDAHNRNRQTLCSLLPRESRSHNTDAALLPCISYPAFALDDEVLFSQTLDKIIRKLKGKYGFKRFLRDGYRTALEDKTRRYYKPAEIKLFDGIECEFPLFFIFMIIDGVFRGNLAQVKEYQDLLDPVLQHTSEGCPVVPKYYYVPADFVELEKKNPGSQKRFPSNNGRDGRFFLWGQAVYIIAKLLADKLVSPKDIDPIGRYVPPQEQRNVSMRFSNQGPLENDLVVHVALIAESQRLQVFLNTYGIQTQTPQQVEPIQIWAQKELVKAYFHLGINDKLGLSGRPDRPIGCLGTSKIYRILGKTVVCYSIIFDLSDFYMSQDVMMLIDDIKNALQFIKQYWKMRGRPLFVVLIREDNIRGSRFNPILDMLAAFKKGIVGGVKVHVDRVQTLVSGAVVEQLDFLRITETEEAPVFKSLEELDLPKHSKVKRQSSTPNASELEQQPDININDWKNKSTYEILQKLDDCNCLASQALLLSILLKREGPNFITKEGTVAEHIERIYRRAGSKKLWSVVRFAASLLGKLVDSLAPSITNVLVQGKQVTLGAFGHEEEVISNPLSPAVIKNIIYEKCQLQDEREAVVQQELVIHIGWIISNSPELFSGMLKIRIGWIIHAMKYELKFRAGDMPAKDLYQMSPSEVKQLLLDILQPQQQGRGWLNRRQIDGSLNRTPAGFYDRVWQILERTPNGLIVAGRYLPQQPTLSDMTMYEMNFSLLVEDMLQNIDQPEYRQIIVELLMVISVILERNPELEFQDKVDLDKVVQEAFHDFQKDHNRPKGAEHQDDMTAFYNTHPVGKKGTCSYLSKAVISLLLEGDVKTSNDDPCTIS

SEQ ID NO: 2459 - protein, 4885 aa, Meleagris gallopavo
  MOD_RES (3443)..(3443): Any amino acid
GGHRTLLYGHAILLRHSFSEMYLTCLTSSRSQTDKLAFDVGLRENAAGEACWWTIHPASKQRSEGEKVRIGDDLILVSVSSERYLHLSMSNGSIQVDASFMQTLWNVHPTCSGSNITEGYLLGGHVVRFFHGHDECLTIPSTDQNDSQQKKVLYETGGAGVRARSLWRVEPLRISWSGSNIRWGQPFRLRHITTGMYLALNDDEGLVMLDREKSDTTSSAFCFRASKELKEKQDSTLKRDIDGMGVPEIKYGDSVCFVQHVASALWLTYKAPDAKSARLGLLKRKVILHQEGHMDDGLTLQRCQHEESQAARIIRNTTSLFSQFISHVDDYVSIPNGNNRTLSPIALPVEEMAQTLQDLIKYFQPPGEDLEHEDKQNKLRSLKNRQNLFKDESKIKLKLKICSSVLTCFTDILLTSKISSLIKLLSPLGYSNLFVKLLSALIRGNRNNCTQFSSNLDWLISKLDRLESSSGILEVLHCILIESPEALNVIAEEHIKSIISLLDKHGRNYKVLDVLCSLCVCNGVAVRANQNLICDNLLPRRDLLLQTRLINDVTSIRPNIFLGVAEGSAQYKKWYFELIIDQVDPFLTAEPTHLRVGWASTSGYAPYPGGGEGWGGNGVGDDLYSFGFDGLHLWSGRVPRAVASVNQHLLSSDDVVSCCLDLGVPSISFRINGQPVQGMFENFCTEGFFFPVVSLSAGVKARFLLGGRHGEFKFLPPAGYAPCYEALLPKEKMKLEPVKEYKRDSDGVRDLLGTTQFLSQASFIPCPIDTSQIALPFHLEKIRDKLAENIHELWGMNKIELGWTYGKIRDDNKRHHPCLVEFSKLPETEKNYNLQMSTETLKTLLALGCHIVHANPAAEEDLKKVKLPKNYIMSNGYKPAPLDLSEVKLLPSQEFLVDKLAENAHNVWAKDRIKQGWTYGIQQDLKNKRNPRLVPYALLDERTKKSNRDSLREAVRTFAGYGYNVEPPDQEIADQTLEKVSIDKIRFFRVEQSYAVKSGKWYFEFEAVTGGDMRVGWARPGCRPDIELGADDQAFVFEGSKGQRWHQGSGFFGRSWQPGDVVGCMINLDDKSIIFTLNGELLITSKGSELAFADFGIESGFVPICSLGLAQIGRMNLGMDASTFKYYTMCGLQEGFEPFAVNMNRDVAMWFSKRLPTFVNVPKNHPHIEIWRIDGTIESPPRLKVTHKTFGTQNSNSDMIYCRLSMPIEFRSSFNFGVGVENASSDALQKRLDIECRTLYTDKIGESFLKSHSLLSTCHPSEICGTCKALYLTVIGKVKFYSHAKKKRLFSSIFRKHSQEFPASSTTVSNHTEHYLTTSSENNLVLITDMFFSSFQYFYSLRIFAGQDPSSVWVGWVTPDYHFYSENFDINKNCTVTVTLGDERGRVHESVKRSNCYMVWGGDITANSQRSGRSNVDLEIGCFVDLATGMLSFTGKELGTCYQVEPNTKLFPAAFVQPTSTNLIQFELGKLKNTMPLSAAIFKSEERNPVPQCPPRLDVQTITCLWSRMPNSFLKVETERVSERHGWVVQCLEPLQMMALHIPEENRCVDILELCEQEDLMKFHYHTLKLYSSVCALGNTRVAYALCSHVDISQLFYTIDNQYLPGLLRSGFYDLLISIHLDHAKQAKLMMNNEFIIPVTEETRTIKLYPDETKKHGLPGVGLSTCLKPSFNFSTPCFIVTSEEHQTSSPEIPLDTLKSKAISMLTEAVQCSGSHIRDPVGGHIAFQFVPVLKLIATLLIMGVFDDDDVKQVLILIDPNVFGDNKEETEERTEKEEVTQVEEKAVEAGEKAVKETKTPTKGLLQTRLPESVKLQMCHLLNYFCDCELQHRVEAIVSFADHYVSKLQYNQKYRYNELMQALNMSAALTAKKTKEFRSPPQEQINMLLNFQLGEDCPCPEEIRDELYDFHDDLLIHCGIPLEEEEEEEEDSSLTGKLRSLIYKIKGPPKPEKIEPREEEDKSPTTLKELISQTMVRWSQEDQIQDPELVRIMYTLLRRQYDSIGELLQALRKAYTISAGSVKDTINLLAALGQIRSLLSVRMGKEEELLMINGLGDIMNNKVFYQHPNLMRVLGMHETVMDVMVNVLGGDKSQQIVFPKMVASCCRFLCYFCRISRQNQKAMFEHLSYLLENSSVGLAFPSMRGSTPLDVAAASVMDNNELALALEEPDLDKVVTYLAGCGLQSCPVLLAKGYPDIGWNPIEGERYLSFLRFAVFVNSESVEENASVVVKLLIRRPECFGPELRGEGGNGLLAAMQEAIRISENPSRDLPSQGYKREGDEEEEEEEIVHMGNAIMSFYSALIDLLGRCAPEMHLIQSGKGEAIRIRSILRSLVPTEDLVGIISIPLKLSTVNKDGTVNEPDMSANFCPDHKAPMVLFLDRVYGIKDQSFLLHLLEVGFLPDLRASASLDTVSLSTTEAALALNRYICSAVFPLLKRCAPLFSGTEHHASLVDSMLHTIYRLSKGRSLTKAQRDTIEECLLAICQYYSHLRPSMLQQLLRRLVFDVPLLNEYCKMPLKLLTNHYEQCWKYYCLPSGMGSYGIAAEDELHLTEKLFWGIFDSLSHKKYDPELFRMALPCLSAIAGALPPDYLDTRIRSTLEKQTSVDPEGNFDPKPINTANLVLPEKLEYIVSKYAEHSHDKWAFDKTNNGWKYGVSLDENTKTHPLIRPFKTLTEKEKEIYRWPVRESLKTMLAMGWSLERTKEGGEAMLQQRENEKLRSISQSSQVWWSSEGNGYSPAPLDLTNVVLSRELQGMVEVMAENYHNIWAKKKKMELESKGGGSHPLLVPYDTLTAKEKSRDREKAQELFKFLQVNGIIISRGLNDMDLDASSMEKRFAFKFLKKILKYVDSAQEFIAHLEAIVTSGKTEKSPHDQEIKFFAKVLLPLVDQYFTNHCLYFLSSPTKTLSSSGYASNKEKEMVASLFCKLAALVRHRISIFGKLLRKILINCLHILAQSLDTRTVMKSGSELVKAGLRAFFENAAEDLEKTSENLKLGKFTHSRTQIKGVSQNINYTTVALLPVLTSIFEHISQYHFGVDLLLGDVQVSCYRILCSLYSLGTGKNIYVERQRPALGECLASLAAAIPVAFLEPSLNHYNPLSVFNTKSARERAILGMPDTVEEMCPEIPQLDGLIKEINNLAESGARYTEMPHVIEVILPMLCNYLSYWWERGSESVPESAGPCCTMITSEHLSIILGNILKIINNNLGIDEASWMKRIAVYAQPIISKARPDLLKTHFIPTLEKLKKKAIKIVMEEEQLRADSKSDTQEAELLILDEFAVLCRDLYAFYPMLIRYVDNNRANWLKKPDADSDELFRMVAEVFILWCKSHNFKREEQNFVIQNEINNLAFLTGDTKSKMSKSGGQDQERKKSKRRGDLYSIQTSLIVAALKKMLPIGLNMCTPGDQELISLAKTRYSHKDTDEEVKEHIRNNLHLQEKMQSDDPAVKWXQLNLYKDILKSDEPPDPEKNVERVQRISAALYHLDQVEQPLRSKKAVWHKLLSKQRKRAVVACFRMAPLYNLPRHRSINLFLHGYQNYWIETEEYSFEEKLVQDLATSPKKEEEEEEDTEKEQPDPLHQIILYFSRNALTERSKLEDDPLYIAYAAMMAKYKSCQEEEEEEEEDKEKTFEEKEMEKQRTLYQQARLHDRGAAEMVLQMISASKGHTGPMVVETLKLGIAILNGGNTIVQQKMLDYLKEKKDAGFFQSLSGLMQSCRSVLDLNAFERQNKAEGLGMVTEEGTLIVRERGEKVLQHDEFTRDLFRFLQLLCEGHNNDFQNYLRTQMGNTTTVNIIISTVDYLLRLQESISDFYWYYSGKEFIDESGQRNFSKALAVTKQIFNSLTEYIQGPCIGNQQSLAHSRLWDAVVGFLHVFANMQMKLSQDSAQIELLKELLDLLKDMVVMLLSLLEGNVVNGTIGKQMVDTLVESSSNVELILKFFDMFLKLKDLTNSDAFKEHDPDGKGIISKKDFQKSMEAQKQYIQSEIEFLLSCTEADENDMFNYIDFVERFHEPAKDIGFNVAVLLTNLSEHMPNDSRLQSLLEPAESVLNYFEPYLGRIEIMGGAKKIERVYFEISESSRMQWEKPQVKESKRQFIFDVVNEGGEQEKMELFVNFCEDTIFEMQLASQISETDSAERPEEEEEEPCYIVDIGDDEEEEKSLESPSAFAMACAAVKKNVANFFKMVTVKNLRKQYRKVRKMTVKEMVKVFFSFFWILFVGVFQLFFTIVWGIFQILWSTVFGGGLVEGAKNIKVTKILGDMPDPTQFGIHDDVTEAEKTEGAEHGIRDELVQFVKGEKGEADIISDIFGIPTKKEGGSKHGHDAGLGDIAEILGSDIQSSLENNVRKKKGLQTPETAKDAEAERKVEAEKADMEDGEKQDKAKEEHSEQQEEGKTKKKKRRHGQKIEKPVAVMANFFKALEIYQTKMLHYLARNFYNLRFLALFVAFAINFILLFYKVTEEPLDEVEEDSNLWNSFEEEEEEEGMVFFVLEESTGYMAPTLRALAVIHTIISFVCVIGYYCLKVPLVVFKREKEVARKLEFDGLYITEQPSEDDIKGQWDRLVINTPSFPNNYWDKFVKRKVINKYGDLYGAERIAELLGLDKNALDFSPVEESEPEAASLVSWLSSIDTKYHIWKLGVVFTDNSFLYLAWYTTMSILGHYNNFFFAAHLLDIAMGFKTLRTILSSVTHNGKQLVLTVGLLAVVVYLYTVVAFNFFRKFYNKSEDEDEPDMKCDDMMTCYLFHMYVGVRAGGGIGDEIEDPAGDPYEIYRIVFDITFFFFVIVILLAIIQGLIIDAFGELRDQQEQVREDMETKCFICGIGNDYFDTTPHGFETHTLQEHNLANYLFFLMYLINKDETEHTGQESFVWKMYQERCWDFFPAGDCFRKQYEDQLG

SEQ ID NO: 2460 - protein, 6736 aa, Meleagris gallopavo
MDYSSFSGVPRFLTRPKAFIVSVGKDATLSCQIIGNPIPVVSWEKDKLPIQSGGRFKTTEDGDLYQLTIYDLSLEDSGQYICRAKNTIGEAFAAVSIKVGEETTVTESAPYFIQKPSSIKVTLGEDAMFKCKVQGSPPLSVNWEKDGRHLRNRADAGRFQIESAGESNALTIQCARLGDSGTYTCRAENPIGSASASAALVVESQGSSNPGSHFDTSCGKTSSLLSHLQKRREEITTKGARNAMFGTLTRSCSVTEGKHAKLSCYVTGEPKPEIVWKKDNEVIVEGRRHVIYEDDQENFVLKILYCKQVDNGLYTCTASNLAGQTYSSVLVTVKEPPIPFKEKLKDLEVWEKESATFQCEVPVPSTETSWFKEETKLRQSKKYNIEEEGTYRRLTVQNVTADDDAVYICEMKEGSRTIAELSVQGNIIKKLPRKTAVSVNDTAIFCVELDNECQNIRWLKNTEEVKPSDRISITRSGKQYTMIIRECTMEDAGEIVFLADESRTSTQFTVTIPRKPPTQPPVDPVVKNKTETSVTLAWSPPKMHRPIPIDGYVVERKKLTGFTWVRCHESHVPVPEFTVSNLSEEADYQFRVSAVNAHGQSPYLEFPGSVHLEPVLAVKSPLTTGEAVYGGDAMFTIDLTTTCSGTWYLNGKVLQESETCIIKRTQTTHSLIIKNVTKNDDGAEVKFVAKNVDVSTKMRVRGAAVRFTNKSKDIEKISARLREEAKLQAELSDTDATVKWMKDGKELKANEKYELQTVGKRRILKIHNVAMEDAGTYQCICEGDKMLYQLSVKALANFINKEKTGGVIRAVAGKQAEFVSETSEANVMVKWYKNGKEITASKKFTMEDKGKLHKLVASAVTKEDEGTYICKIGDDTLIFDLKVSDEAVNFVNKPKTTPEISVSPSEDLELVCEVSAASGAVVWKKDQTEVKQDQRTTIISQGTHRKLIVKNVTLKDQGSYSCETKDDKATFQVKVREKEDVFTNKEKVQKEVKAAATENATLSCEVAQDKTEVKWYKEGKLITSSKKFRVESEGKLRRLVVSQVEKKDAGEYSCEAAGQKLTFRIHVTEAEDAFINKEKVQKEVKAAATENATLSCEVAQDKTEVKWYKEGKLITSSKKFRVESEGKLRRLVVSQVEKKDAGEYSCEAAGQKLTFKIHVTEAEDAFINKEKVQKEVKAAATENATLSCEVAQDKTEVKWYKEGKPITSSKKFRVESEGKLRRLVVSQVEKKDAGEYSCEAAGQKLTFRIHVTEPEVVFTNKEKVQKEVKAAATENATLSCEVAQDKTEVKWYKEGKPITSSKKFRVESEGKLRRLVVSQVEKKDAGEYSCEAAGQKLTFRIHVTEAEDAFINKEKVQKEVKAAATENATLSCEVAQDKTEVKWYKEGKLITSSKKFRVESEGKLRQLVVSQVEKKDAGEYSCEAAGRKLTFRIHVTEAEDAFINKEKVQKEVKAAATENATLSCEVAQDKTEVKWYKEGKLITSSKKFRVESEGKLRRLVVSQVEKKDAGEYSCEAAGQKLTFRIHVTGCIWNDESATHSKRPDRAELSIPGTQSKISANHAQEQRTGLVRQKNRRLVMSKGTMKLQTYLCTLPATMLGYLSALGRNSGAFGCLEERCSLVLHSEPKAVFINQEEVQKEVSAVLAESAALSCEVAQDTTEVKWYKDGRLLASSRKFKMETVGKTRRLVVEQVEKKDAGEYICEAAGQKLTFKLEATEPEAKFGKEFVQKEPLIVQEHESITLTTSVTPETAVVKWYKDGREIKASKKYEIKSDGASRTLTVNLAESTDTAVYACQTKNDKQEFKVEVKEIPVKFTKKLEAVKAEIGGSVTLSCEVSHAKGKVVWRRNAVEIKPSKRFQIHEEGVRRTLTITGIRAEDEGEYFCESRDDKSSITITPKAPRVVKFVTSLNNVASEEGKEAVFKCTVSPSDAVVTWFRNGVKIEASKKYVISQKDTNHSLTITDLTLEDAAEISANAEGVESTANLRVREASISFKKKLEPKTVEERDTVTLEVELTKPGEVKWMRNSIVLKPSEKIEIKAEGTKHILIVKDISFADRGFYCCESPDDKTQAKINVEMRQIKLVKGLQPLEVSEKGTVTFSVEVSHEDVEGTWQKDGVRLKPAPNITMGVQGKKHSLTLSSVTLEDAGLVSFKAEGINSSGRLTVIELPVKISKPLADISVTQKDKVTFECELSRPNVDVKWFKDGKELRQSKKVGITSQGNKRSLIIHKCEYEDQGTYTCQAAEDKTSATLKVHAGKTYSLTYTRVQVKDAAEIKFVAEKAESRAHLTVKELPVKIVKPLRDKIALEKHRGFLECQVSRANAEVKWYKKDVEIHPSDKYEIVSDGVYRKLIINDAGYEDEDTYTCDAFDDKSSAHFFVEEQSINIVKELCDEDVTEPEEAKFECEISIPSVKPPKWYLRGEVLQPGRNIIMQQEGTIHRLTILKTSTDMTGTIQFSIGKSKSTANLLVRDYHIQITRKLEDKTALERHSVILSCDFRPSPKVVKWFKGHTPIEPSEKYKIKRDKHSAELKILKLKPDDAGVYKCKAGIAETEATLTVEARNVEVTKHLQDVEVEEESSAVFSCELSHDDEDVEWFLNGTLLYTNNYNDIKNVGSCYTLTMKQVKPEDAGTVTMKSDKVSESARLKVIEKPAVFMKSLDDVFGEERGVIKLECEVSKEKVKPVWKKDGVVLTSGNKYELVQSGKTLCLLIHDLEKADAGLYTCDIGTDVAKSKVGVQELNIGITKRLKNTEIQEGEDCTFECILSHESIGDFNWTLNGSRVESGGRFKASNVGRKYTLSIKSVIPADAGEVVFTARGLTSKASLSVKEKPTEVTKQLEDKTSAAGQDISLSCELSKPDVNIRWYKDGKAIRKSQKYDLQQEGTKAILIIHDSTVKDSGEYTCETEDSKTKARVTVQEKPNYFIKELSDLKIEESGTAVFICQSEKAASSVIWRKGIAELRPGRKYEMTQKGRDLQLTIKNLEKSDGDTYTCDIGDAQSRAKLVVQGQKVLITEDLEDVTVLEGESAMFKCRISPIEYSKVQWFLDKTPLHTNELNDIQSQPGGYHLLTLKKLSLKDSGLITFEAGDKKTSASLVVKEKPCIFTKELVDTEVTEGKDVILHCETSKSDSPVKWCKDGKSLRNSSKYNISRSGFEAKLVIYGAEERDSGRYECEAGAAKSSAVITVKAISVLFEEELKSLEALEGGTATLHCQLSREAPVEWRKGHTVLRPSNKYRMRQEGTVAELLIHDLATKDAGDYTCVVGSQKTTATLSVNALPILFQEEMVDKEATEGQAVTLHCKLSKSAPVEWRKGNKVLKPSEKYKIEQEGPFAELVIQDLDSADAGDYSCVCGNQQTTATLTVNVLPTLFTKELSNEEATEGKSVSLCCELNKAAANVEWKKGLKTLKSSDKYKMKREGITAELLIQNLDMTDAGNYSCVCGDQQTMAVLTVHALPAFFKEGLKNREATDGGTATLRCELSKVGVPVEWKKGNKMLKSSDKYRMRQEETSAELLIRDLDVEDTGEYTCVCGDQKTSAVLTVHALPALFKKELVDVEATESGTAVLQCELTKSAPVEWRKGQESLKPSEKYKLRLKDTIAELIIQSLEEQDAGDYTCVCGDKTTTASLTVHALPAYFKEEMKNEEATEGGTAMLQCELSRAVPVEWKKKHKVLKLSEKYSMRQEGSTAQLLIHALEVKDAGEYTCVCGDKKTTAVLTVHALPALFKEELRNEEATEGDVVTLRCELTKAAPVEWRKGHAVLKSTSEKYIMRQDDVLAELEIRELDLQDAGDYTCVCGDHHTTASLTVNALPAVFKEELKNEEVVEGASVSLRCELSKAAPVQWKIGPKVLKTSEKYQMSQPGTIAELVIRDLDVTDAGDYTCVCGDQKTTATLTVHDFAALPVTFKQILQNKESEEGSTATFCCELSKPNAAVEWRKGGVGLQPDEKYEMRQRECLVELLIHNLQLEDTGEYSCDTGDQETKASLHVKALPVLFKKELKDEEVEEGAAVKFQCELTKDNAAVEWRKGTMEIFPCSKYEMRLSGCTAELVIHNAEPEDASDYTCDTGDQQSTAILRVNAIKPRLKQQLKNEEVEVGGTAKLRCEISISKAEVEWSKDGAVLHSSSKYEMWQQGTIRELRVHHLEPSDAGEYSCKAGDETTSAKLTVKEPDVTIVSHLKDMVVFEGDDVTFQCQVSHENARDVEWKLQDVALQNNEMNEISVEKGKIHKLTLRKVTEQDLGTITFRVGPYTSTAELTVKEPAPTIVEMLKDVTSYEGEDAVFECRLSQETTQDAQWFLGDVPLQSNEMNEIKVQGTRHTLILKKVTLEDCGPISFKVGQHTTGAQLTVQAKNSIVQGLENVEAVEGGEALFECYLSKPECYNYNWLIDDEPAKTTENTEMVYFENGRRHLLLLKNLTLQDSCRVTFMCSDAVTSAFLTVKGWRLQILEPLTDVEVSPGQKATFSCALSEAVPINEVTWYFNDIEIQPDEDWEIQADGNKYKLILNKAQPHHSGEVTFASREAIASAKLSVLAHPDPPEEPKVLRTSSHSVTLSWYKPLSDGGCDILGYQVERKIPGVGWQSCNKSIIQGMELVVDNLTPGEPHRFRVSAVNKVGASEPAQFPQMVQLVTEPSVTVTHPLVGGSVSEGEVARLECKLSSEIKENVTWLKGKEPIQTGGRYEILSDGKKQILIIHAFKAEDQDTYTCMVSPEQMCKELKTCHLALFYEELVDGHVQPSLPPEAAQEGDLHLLWEALAKKRRMSREPTLDSISEVPEEEEKLQKLRKEEAEQSHYYSEEYSTCDELARTGEADFSFTSSDDESRAGTPSLVNYLKKAEKRSVSVTTKVQSISSGKLWKQWEKSSVETVVAAPGAKPVEPEIVDLDDPSMNSAAVKIQAAFKGYKVRKEIKQQECPVFTETFKDFSGEPGSTLHLECVAHSKTDMKVRWLKDGEELSDGRYYHIDNYSDGTCSLIITGLDRKDAGKYTCEASNKFGKVSHSAKVVIESTDSETESSSGSELDDAFRKAGRRLHRLFRSKISTEISDVEEELFVSADEGDVEVVDHQTYREDDQYIYIKFEVLSEAKTAATRFREMFGALGIPVEIDILEQGPRKVELRIGKATPPTHGKFAPPVLRPPPPLLTSDTAPMFLTELQNQEVQDGYPVSFDCIVVGKPLPTVRWFKDGKAIEENDHYMINEDQEGCHQLIITAVVPTDMGVYRCLAENNMGVASTKAELRVDLTSTDYETAADATETSSYYSAKEYVSSREQEESTTEEEQLPQILDDLHDIHVAPGAPLAKFHLKVKGYPEPRLYWFKNGQPLKASDRILKIDRREFHSLEILNVMKSDAGQYSIFLINSAGSAYSSARLVVRDPDEKEEESETDSHEQLIPPRFLERFTNKKVKKGASITLSVKVEGHPPPTITWLKEESQEDILWIKPDTPGYKLASSNMHHSLILLDVKKKYSGAYTCIATNKAGQSICTANLEVADVKEAEVLTQERVMVSEAIMTTLGFLCTAEIFSHLGLITTHFRDLEAGREGVPRTPISLADVGTEEFFQKLTSRISEMVSAKISQATLRVPGAESDDESKTPSASPRHGRSRPSSIAQESSSESEDGDSRGEIFDVYMVTADYVPPAPDKETITLKEGQYVEVLDSAHPLKWLVRTKPTNPSRQGWVSPAYLDKRLKLSPEWGTTEVPEFPGEFVSEDEYKRKLSVLIQELLISEEDYIQDLQFLQTHHLRYTETCPSVPGAIASQKSTIFRNIDDITRFHSSAFLRGLQKCDTDDDVAMCFIKHEAEFNKYIQYLVGRVQAESIVVSKAVQDFYKRYTDEILMKEDPSQTLIPPLQHYLEKPINRIQQYQTVIKELIRNKARNSQNCTLLEQAYAIVSALTRRAENNLHVSLIENYPGTLESLGEPIRQGHFIVWEGAPGARMAWKGHKRHVFLFRNYLVICKPKRDTRTDTYSYIFKNIMKLNNIDVNDMVEGDDRAFEIWHEREDSVRKYLLQARTVNIKNSWVKEICGIQQRISQPVWIPPDFEEELADCTAELGETVKLACKVTGAPRPSVSWYKDGKPVEVDPHHIIIEDPDGSCTLILDNLTGVDSGQYMCFASSPAGNASTLGKILVQVPPRFVNKVRNAYFVEGEDAQFTCTVEGAPRPQIRWYKDGILLKDTNKYQTFSEPRSGIIVLVVKNPSNEDMGHYECELVNRLGSAKSGAELYHHTAAALTQERRGDQAITIEGMVLVQLFQQINSLNKRLKCPRKPSSLFSVMTFSYHPCPSGASGLYEAMAPPPSGFYPKPAKEPRVPMPSLGLSHEETSTGAESTQERTVPISRLHERIPPAAGTGDWCRREGDVVWDVHSEVYIETTERTRVYKTEEKTPTSPPYMQVTIEDVQVNSGERAKFQAVIEGTPPPTVLWFKGTTLLTDSVRLHQGKTGTTYFLILDNVVSEDGGVYTCVAKNAGGEVLCKAELVVHEAKKDQAAKKVATRRKLHSLYEVKQEIGRGCFSFVKRVVHKGNGVSCAAKFIPLRSKTKARAHQERDILSSLSHDRITRLLDQFETRKTLILILELCSSEELLDRLFKKSVVTEAEVKLYIKQILEGINYLHDNNILHLDIKPLNILMVYPEREDLKICDFGFAQKITPLEPQFSKYGSPEFVAPEIVSQSPVSKATDIWAVGVITYLSLTCKSPFAGENDRGTLLNIQKGDVSWTAPDFVHLSEDAKDFIKRILQQQPRDRPGALDCLSHRWFMVS

SEQ ID NO: 2461 - protein, 347 aa, Meleagris gallopavo
GTAEVSSILEERILGANTSAELEETGHVLSIGDGIARVYGLRNVQAEEMVEFSSGLKGMSLNLEPDNVGVVVFGNDRLIKEGDVVKRTGAIVDVPVGEELLGRVVDALGNPIDGKSSFTSKMRRRVGLKAPGIIPRISVREPMQTGIKAVDSLVPIGRGQRELIIGDRQTGKTSIAIDTIINQKRFNDGVDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDSFGGGSLTALPVIETQAGDVSAYIPTNVISITDGQV

SEQ ID NO: 2462 - protein, 381 aa, Meleagris gallopavo
MPFSNSHNLLKMKHSADDEFPDLSAHNNHMAKVLTLDLYKKLRDRQTSSGFTLDDVIQTGVDNPGHPFIMTVGCVAGDEESYEVFKELFDPVIEDRHGGYKPTDEHKTDLNADNLQGGDDLDPNYVLSSRVRTGRSIRGFCLPPHCSRGERRAIEKLSVEALGSLGGDLKGKYYALRNMTDAEQQQLIDDHFLFDKPVSPLLLASGMARDWPDARGIWHNDNKTFLVWINEEDHLRVISMQKGGNMKEVFTRFCTGLTQIETLFKSKNYEFMWNPHLGYILTCPSNLGTGLRAGVHIKLPNLGKHEKFGEVLKRLRLQKRGTGGVDTAAVGGVFDVSNADRLGFSEVELVQMVVDGVKLLIEMEKRLEKGQSIDDLMPAQK

SEQ ID NO: 2463 - protein, 456 aa, Meleagris gallopavo
PSLTPQRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIATIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 2464 - protein, 672 aa, Meleagris gallopavo
MAPKGKVYRGSVKDFPGFNASQDADALYNAMKGFGSDKDAILDLITSRSNKQRVEICQAYKSQYGKDLIADLKYELTGKFERLIVSLMRPPAYSDAKEIKDAIAGVGTDEKCLIEILASRTNQEIHDLVAAYKDAYERDLEADIVGDTSGHFKKMLVVLLQGAREEDDVVSEDLVEQDAKDLLEAGELKWGTDEAQFIYILGRRSKQHLRMVFDEYMKISGKPIERSIRGELSGDFEKLMLAVVKCIRSTAEYFAERLYKAMKGLGTRDNTLIRIMVSRSEIDMLDIREVFRTKYEKSLHNMIKEDTSGEYKKALLKLCGGDDDAAGEFFPEAAQVAYRMWELSAVAKVELRGTVQPVGNFNDDGDAQVLRKAMKGLGTDEGAIIEVLTQRSNAQRQQILKAYKAHYGRDLLADLKSELSGSLAKLILGLMLTPAQYDAKQLRKAVEGAGTDESTLIEIMATRNNQEIAAINEAYQQAYHKSLEDDLSSDTSGHFKRILVSLALGNRDEGPENLTQAHEDAKVVAETLKLADVASNDSSDSLETRFLSILCTRSYPHLRRAQVFQEFIKMTNHDVEHAIRKRMSGDVRDAFVAIVRSVKNKPAFFADKLYKSMKGAGTDERTLTRIMISRSEIDLLNIRGEFIDLFDKSLYHMIEKDTSGDYRKALLALCGG

SEQ ID NO: 2465 - protein, 705 aa, Meleagris gallopavo
SIQPCPDVKYGKRIHVLPIDDTVEGITGNLFEVYLKPYFLEAYRPIRKGDIFLVRGGMRAVEFKVAISPRPVTSQTPGTGEALSNYCFHLSDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGDLTVTKILSCSLRMALQMLCFQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLDFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGTGGGSGGNVYSEDNDDDLYG

SEQ ID NO: 2466 - protein, 983 aa, Meleagris gallopavo
VSFFFCLIVLIFPTAVCFAAPPKTTIRWCTISPLEEKKCNNLKDLTQQERITLTCLQKATYLDCIKAIANNEADAISLDGGQVFEAGLAPYKLKPIAAEVYEHTEGSTTSYYAVAVVKKGTEFTVNDLQGKTSCHTGLGRSAGWNIPIGTLIRRGAIECCVPGATTEQKLCRQCKGDPKTKCARNAPYSGYSGAFHCLKDGKGDVAFVKHTTVEENAPDQKDEYELLCLDGSRQPVDSYKTCNWARVAAHAVVARDDSKAEDIWSFLSKAQTDFGVDTKSNFHLFGPPGKKDPVFKDLLFKDSAIMLKRVPSLMDSQLYLGFEYYSAIQSLRKDQLTPSPRENRIQWCAVGKDEKSKCDRWSVVSNGDVECTVVDETKDCIIKIMKGEADAVTLDGGLVYTAGVCGLVPVMSERYDDGSLCGRPEEQPASYFAVAVVKKGTDVNWNNLKGKKSCHTAVGRTAGWNIPMGLIHNRTGSCNFDEYFSEGCAPGSPPDSRLCQLCQGSGEIPPEKCIASSHEKYFGYTGALRCLVERGDVAFIKHSIVEENTGGKNKAEWAKDLQMDDFELLCTDGRRANVMDYRECNLAEVPTHAVVVRPEKANKISELLEKQEKRFGVNGSEKSKFMMFESQTKDLLFKDLTKCLIKLRQGVTYKEFLGDKYYSTISSLNTCNPSDWNCVTLASTRMKDFYLPLENKQSGSLLVGCWTCFPCCDNVGMVGCVLVGQQCVAFSDSVQGLNFSLSFSFSDLLQVCTFLQNNICALVSPRLSHCLPSSQQLPIVVGIWDAGKTLLFARLLTGKYRDTQTSITDSSALYRVSNGKSTNVTLIDLPGHESLRLQFLERFKAAARAIVFVVDSVAFQREVKDVAEFLYQVLVDSTVLKNAPALLIACNKQDVTMAKSAKLIQQQLEKELNTLRVTRSAAPTSLDASATGGPAQLGKKGKDFDFSQLPMKVEFVECSARGSKGEEGDADFEGLEKWLAKIA

SEQ ID NO: 2467 - protein, 1170 aa, Meleagris gallopavo
QSVVKLMRGLLQCMMRQVDKVEAFKYSQSTRDCLHAKYNTHTCATVVGDHEWGHLQLDATSLYLLMLAQMTASGLHIIHSLDEVNFIQNLVFYIEAAYKTADFGIWERGDKTNRGITELNASSVGMAKAALEALDELDLFGAKGGPQSVIRVLSDEVQHCQSILHSMLPRASSSKEVDASVLSVISYPAFAVEDSELVEITKQEIITKLQGRYGCCRFLRDGYRTPKEDPNRSYYEPAELKLFENIECEWPLFWTYLIIDGIFSGNVEQVQEYREALEGILIKGKNGVRLVPELYSVPPDKVDEEYNNPHTVDRIPMGKLPLMWGQSLYILGCLMAEGFLAPGEIDPLNRRFATVPKPDVVVQVCILAETEGIKAILRKEGIHVETVADVYPIRVQPARILSHIYARLGRNKQMSLTGRPYRHMGVIGTSKLYNIRKNIFAFTPQFIDQQQFYLALDSKMIVEMLRTDLSYLCSRWRMTGRPTITFPVSHTMLDDTGSSIHPTVLATLRKLQDGYFGGARIQTGKLSEFLTTSCRTHLSFMDPGPEGKVFANGYKLGLDSFEELDPEEWLHGLQFAEDADTYDEVAQYLDHLLQRTVPQSNLPPTAQQGGLKRFRAAVHTTRDLMSLASKAKDLQVQNVGMYIPSKIFQASQQSVKLLSSPHQHDQEVKSHTLHAEMNLPRDEAGNVDCKALVDQLRICPTLQEQADILYMLHILKGPEWHTGLESEPGPTVKELLTELYVRVGATRQWALIRYISGILKKKVEALDEACTALLSHQKHLTVGLPPEPREKTISAPIPYEELVRLIDEASEKNLSVSILTQEIMVYLAMYIRTQPALFTDMFRIRIGLIIQVMATELAHSLHCSAGEATENLMNLSPSNVKTLLFHILSGKEFGVEKSVRSVDSLVTTAINVYDVEAAGATKTERAGIVKLKSEIKQVRAGSADCFPKAGGAALQAAGSWGCGEGSVGGSSVGGSSAPGTRLGGHKLSGSNQSSKDSRQGQWKRRRRLDGALNRVPLGFYQKVWKVLQKCHGLSVEGFVLPSSTTREMTPGEMKFAVHVESVLNRPQPEYRQLLVETILVLTMLVDVEVHTMGGIIPVEKILHAANDLFYEEQKALGADDQMLEKDPSTGICDLLYDSAPSGRFGTMTYLSKSVALHLYDLLPGDGCAMQ

SEQ ID NO: 2468 - protein, 93 aa, Meleagris gallopavo
ETDDEPSEKDALQPGRKIVAAGYALYGSATLVALSTGQGVDCFMLDPGLGEFILVDRDVKIKKKGKIYSLNEGYAKYFDPAMTEYLKKKKFPE

SEQ ID NO: 2469 - protein, 195 aa, Meleagris gallopavo
TMAERRVPFTFLSSPSWEPFRDWYHGSRLFDQSFGMPHIPEDWYKWPSGSAWPGYFRLLPSESALLPAPGSPYSRALSRQLSSGISEIRQSADSWKVTLDVNHFAPEELVVKTKDNIVEITGKHEEKQDEHGFISRCFTRKYTLPPGVEATAVRSSLSPDGMLTVEAPLPKPAIQSSEITIPVTVEAKKEEPAKK

SEQ ID NO: 2470 - protein, 259 aa, Meleagris gallopavo
MTKYKLVLLRHGEGAWNKENRFCSWVDQKLSSDGIKEAQNCGRQLKALGFEFDLVFTSVLSRSIQTAWLVLEEMGQEWVPIQSSWRLNERHYGALIGLNRAEMALNHGEEQVKIWRRSYDVTPPPITESHPYYEEIYNDRRYKFTDVSQDNLPKAESLKDVLDRLLPYWNEKIVPELRSGKMILISAHGNSSRALLKHLEGISDKDIMNVTLPTGVPVLLELDENLRPLGPHQFLGDQEAIQAAIKKVEDQGKVKSAEK

SEQ ID NO: 2471 - protein, 272 aa, Meleagris gallopavo
QSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKTGSGTMNLGGSLTRQMEKDETVSDSSPHIANIGRLVEDMENKIRSTLNEIYFGKTKDIVNGLRSVQTFADKSKQEALKNDLVEALKRKQQS

SEQ ID NO: 2472 - protein, 334 aa, Meleagris gallopavo
QGEPIRVLVTGAAGQIAYSLLYSIAKGDVFGKEQPLVLVLLDITPMMTVLEGVVMELQDCALPLLREVIPTDKEEVAFKDLDIAILVGSMPRREGMERKDLLKANVKIFKSQGAALDKYAKKTVKVVVVGNPANTNCLIASKSAPSIPKENFSCLTRLDHNRAKSQIALKLGVTSNDVKNVIIWGNHSSTQYPDVNHAKVNVKGKEVGVYEAIKDDSWLKGDFILTVQQRGAAVIKARKLSSAMSAAKAICDHVRDIWFGTPAGEFVSMGVISDGNSYGVPEDLLYSFPVVIKDKTWKFVEGLPINDFSREKMDLTAKELTEEKETAVEFLSSA

SEQ ID NO: 2473 - protein, 327 aa, Meleagris gallopavo
CARRLTLWLLSLFQVGSVQGLGGTGALRIGAEFLRRWYNGNNNTSTPVYVSSPTWENHNSVFMDAGFKDIRTYRYWDAAKRGLDLQGLLDDMEKAPEFSIFILHACAHNPTGTDPTPDQWKQIAAVMKRRCLFPFFDSAYQGFASGSLDKDAWAVRYFVSEGFELFCAQSFSKNFGLYNERVGNLTVVGKDEDNVQRVLSQMEKIVRTTWSNPPSQGARIVATTLTSPQLFAEWKDNVKTMADRVLLMRSELRSRLESLGTPGTWNHITDQIGMFSFTGLNPKQVEYMIKEKHIYLMASGRINMCGLTTKNLDYVAKSIHEAVTKIQ

SEQ ID NO: 2474 - protein, 339 aa, Meleagris gallopavo
MSTVHEILSKLSLEGDHSLPPSAYATVKAYSNFDADRDAAALEAAIKTKGVDEVTIINILTNRSNEQRQDIAFAYQRRTKKELSAALKSALSGHLEAVILGLLKTPSQYDASELKAAMKGLGTDEDTLIEIICSRTNQELNEINRVYREMYKTELEKDIISDTSGDFRKLMVALAKGKRCEDTSVIDYELIDQDARELYDAGVKRKGTDVPKWINIMTERSVPHLQKVFERYKSYSPYDMLESIKKEVKGDLENAFINLVQCIQNKQLYFADRLYDSMKGKGTRDKVLIRIMVSRCEVDMLKIKSEFKRKYGKSLYYFIQQDTKGDYQRALLNLCGGED

SEQ ID NO: 2475 - protein, 401 aa, Meleagris gallopavo
ADSVERFQGGNNAGHTVVVDGKEYDFHLFPSGIINPKAISFIGNGVVIHLPGLFEEAEKNEKKGLKDWEKRLIISDRAHIVFDFHQAVDGLQEVQRQAQEGKNIGTTKKGIGPTYSSKAARTGLRICDLLSDFDEFSSRFKNLAQQYKSMFPTLEIDIEGQLKKLKGYAEKIRPMVRDGVYFMYEALHGSPKKILVEGANAALLDIDFGTYPFVTSSNCTVGGVCTGLGVPPQHVGDVYGVVKAYTTRVGIGAFPTEQINEIGDLLQSRGHEWGVTTGRKRRCGWLDLVILKYAHMINGFTALALTKLDILDVLDEIKIGVAYKLGGKRIPYFPANQEILQKVEVEYETMPGWKTDTTGARKWEDLPPKAQNYIRCVENHVGVPVKWVGVGKSRESMIQLF

SEQ ID NO: 2476 - protein, 405 aa, Meleagris gallopavo
LTRLLFSRRDHGGPEGMEPDGVIESNWNEIVDNFDDMNLKESLLRGIYAYGFEKPSAIQQRAIIPCIKGRYDVIAQAQSGTGKTATFAISILQQLEIDLKETQALVLAPTRELAQQIQKVILALGDYMGATCHACIGGTNVRNEMQKLQAEAPHIVVGTPGRVFDMLNRRYLSPKWIKMFVLDEADEMLSRGFKDQIYEIFQKLSTNIQVVLLSATMPMDVLEVTKKFMREPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLSLDINVSKVNGVVNLCINVFSVLCRIGRGGRFGRKGVAINFVTEEDKRILRDIETFYNTTVEEMPMNVADLI

SEQ ID NO: 2477 - protein, 486 aa, Meleagris gallopavo
RLACFLTGATKYTDKDNGGMLVWSPYHNIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRNNQGDSDDDVEEPHPMDGNDSDYDPKKEAKKEGNNEQPVQTSKIGLGRREYQSLQHRHHSQRSKCRPPKGMYLTQEDVIAVSCSPNAANTILRQLDMELISLKRQVQNAKQVNSALKQKMEGGIEEFKPPESNQKINARWTTEEQLLAVQGVRKYGKDFQAIADVIGNKTVGQVKNFFVNYRRRFNLEEVLQEWEAEQGTLASNGDASALGEDTKNTSNVPSGKSTDEEDEAQSTPTTQCLGPSPPAQASAPAPTAPMATLNQPPPLLRPALPAAPALHRQPPPLQQQARFIQPRPTLNQPPPPLIRPANSMPPRLNPRPVLTTVSGQQPPSLIGIQTESQSTLH

SEQ ID NO: 2478 - protein, 677 aa, Meleagris gallopavo
PYFYLQVPSTKRADPAELRSIFLQYASVEKDGERYMTPEDFVQKYLGLYTDPRYNPKTVQLLAGVADQTKDGLISFQEFLAFESVLCTPDAIFVVAFQLFDKNGNGEVTFANVKEVFEQTTIHHQIPFNWDCEFIRLHFGHNRKKHLNYTEFTQFLQELQAEHARQAFALKDKNKSGMITGLDFSDVMVTLHSHMLTPFVEENLVSVAGGTVSRQVSFSYFNAFNALLNNMDLIRKIYSNIAGTRKDVEVTKEEFTQSAIRFGQVTPLEIDILYQLTGLYSVTGRLTLADIERIAPLAEGALPYNLAELQRQQSFGELGRPIWLQIAESAYRFTLGSIAGAVGATAVYPIDLVKTRMQNQRSTGSVVGELMYKNSFDCFKKVLRFEGFFGLYRGLLPQLIGVAPEKAIKLTVNDFVRDKFTKKDGSIPLPAEILAGGCAGASQVIFTNPLEIVKIRLQVAGEITTGPRVSALSVMKDLGLLGLYKGAKACFLRDIPFSAIYFPVYAHSKLMLADENGHVGGLNLLAAGAIAEGVPAASLVTPADVIKTRLQVAARAGQTTYSGVIDCFGKILREEGPSAFWKGAAARVFRSSPQFGVTLVTYELLQRWFYVDFGGIKPSGSEPIPKTRILDLPPVNPEHIGGYRLATATFAGIENKFGLYLPKFRSSGTVSAQPKSS

SEQ ID NO: 2479 - protein, 687 aa, Meleagris gallopavo
EKKWKTVIPSWTFNPRLNKGIYKVLQKLGKADETKDEQFEQCVQNFNKQLSEGTRLQKDLRTYLASVKAMHEASKKLTECLQEVYEPDWPGRDDTNKIAENNDLLWTDFHQKLVDQALLTMDTYLGQFPDIKSRIAKRGRKLVDYDSARHHFEALQTAKKKDETKIAKAEEELVKAQKVFEEMNIDLQEELPSLWNSRVGFYVNTFQSIAGLEENFHKEMSKLNQNLHDVLLGLDKQYSGNAFPIKAQPSDSTPAKANKSPSPPPDGSPITSPETKTVNHELEPSTLEAPGASIPKSPSQLRKGPPVPPPPKVTPSKEIKQENIISLFDDNFVPEISVTTPSQARIPEMKSIEGTSLLDLDFDPIKPDATMGKTPTPASQSLPWDLWELSSLITYCARACAIPACICLISLSAFPLCTPQTKVSPYEEEPTCSASEPKQSTHLCPLDLSSLGMSQSTANSPLGDASRLVFCLCDAAVGTNKAFKLAAAPRSDEGRWKKGMVKACKNLFIHVLKMGSVSISSLCCASLKQESISMFNPEKKGIQVLPTEAAHAGAEAAGSEAAAGAEASKTEGDSGSVSTSRSSLPAVVVETFPATVNGTVEGGASSERADMPPGFLFKVQAMHDYTATDSDELQLKAGDVVLVIPFENPEEQDEGWLMGVKESDWIQHKELDQCRGVFPENFTERVQ

SEQ ID NO: 2480 - protein, 728 aa, Meleagris gallopavo
MPEAVQTQDQPMEEEVETFAFQAEIAQLMSLIINTFYSNKEIFLRELISNSSDALDKIRYESLTDPSKLDSGKDLKINLIPNKHDRTLTIVDTGIGMTKADLVNNLGTIAKSGTKAFMEALQAGADISMIGQFGVGFYSAYLVAEKVTVITKHNDDEQYAWESSAGGSFTVRLDNGEPLGRGTKVILHLKEDQTEYLEERRIKEIVKKHSQFIGYPIRLFVEKERDKEVSDDEAEEKEEEKEEKEEKTEDKPEIEDVGSDEEEEKKDGDKKKKKKIKEKYIDEEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFMRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHVYYITGETKDQVANSAFVERLRKHGLEVIYMIEPIDEYCVQQLKEFEGKTLVSVTKEGLELPEDEEEKKKQEEKKAKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDTAAEEASPAVTEEMPPLEGDDDTSRMEEVD

SEQ ID NO: 2481 - protein, 126 aa, Meleagris gallopavo
MPEPAKSTSAPKKGSKKAVTKTQKKGDKKRHKSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 2482 - protein, 171 aa, Meleagris gallopavo
RLCVRVPAEDEMFSDIYKIREVANGLCLEVEGKMVTRTEGQIDDSLIGGNASAEGPEGEGTEATVITGVDIVINHHLQETSFTKESYKKYIKDYMKAIKARLEEHKPERVKPFMTGAAEQIKHILANFKNYQFFVGENMNPDGMVALLDFREDGVTPYMIFFKDGLEIEKC

SEQ ID NO: 2483 - protein, 221 aa, Meleagris gallopavo
LVQVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 2484 - protein, 228 aa, Meleagris gallopavo
VPIAEKMAEKQEEPSNTQNGEPDNAEEGEGKKKKKVKREDLPPFEIVTGERLPAIFFKFQFRNVEYSSGRNKTFLCYVVETQGKESTTSRGYLEDEHAASHAEIAFFNTILPKCESSLRYNITWYVSSSPCVTCADRISETLRKNKNLRLTIMVGRLFMWEEPEMQAALKKMKSAGCKLRIMKPQDFEYVWQNFVEQEEGEEAKAFVPWEDIQENFQYYEEKLAEILQ

SEQ ID NO: 2485 - protein, 295 aa, Meleagris gallopavo; identical to SEQ ID NO: 858

SEQ ID NO: 2486 - protein, 311 aa, Meleagris gallopavo
AAEYSCEYGSLKFYALCGVGGVLSCGLTHTAVVPLDLVKCRMQVDPQKYKSIFNGFSVTIKEDGFRGLAKGWAPTFIGYSMQGLCKFGFYEVFKILYGNMLGEENAYLWRTSLYLAASASAEFFADIALAPMEAAKVRIQTQPGYANTLRQAVPKMFGEEGIWAFYKGVAPLWMRQIPYTMMKFACFERTVEALYKYVVPKPRSECTKGEQLIVTFIAGYIAGVFCAIVSHPADSVVSVLNKEKGSSASQVLKRLGFRGVWKGLFARIIMIGTLTALQWFIYDSVKVYFRLPRPPPPEMPESLKKKLGLTQ

SEQ ID NO: 2487 - protein, 324 aa, Meleagris gallopavo
SLIAVCEAMATYVQLNTGAKMPILGLGTWKSPPGQVTAAVMAAIDAGYRHFDCAYVYQNENEVGEGIQKKIKEGVVKREDLFVVSKLWCTFHEKSLVKGACQKTLASLKLDYLDLYLIHWPVGFKAGEDLFPADDKGMSIPGNTDLLQTWEAMEELVDAGLAKAVGISNFNHEQIERILNKPGLKYKPANNQVECHPYLTQEKLINYCQSKGISVTAYSPLGSPDRPWAKPEDPSLLDDPKIKEIAAKHNKTAAQVLIRFHIQRNVIVIPKSVTPQRIVENFKVFDFELTKEEMATILSFNRNWRACAMSMSQNHKEYPFNAEY

SEQ ID NO: 2488 - protein, 394 aa, Meleagris gallopavo
  MOD_RES (219)..(219): Any amino acid
QGILERLDAGEIVIGDGGFVFALEKRGYVKAGPWTPEATVEHPEAVTEYCGYNNICLGSNEIQTDTLLIRPFFLSKCGQETPEWVYCQKVNEAACDIAREVASEGDAVVAGGVSQTPSYLSCKDKAEVKAVFRKQLDIFMKKNVDFLIAEYFEHVEEAVWAVEVLKESGKPVAATMCIGPEGDMHGVPPGQCAVQLVKAGASIVGVNCHFDPDTALETXAISIQSLKCHCLMAYLHLGCKRSHSPKTLERGTIYSQNFPEGLEPRIITRWDVQKYARKAYDLGIRYIGGCCGFEPYHIRAIAEELAPERGFLPEASEKHGSWGNSLSMHTKPWVRARARKEYWENLKPASGRPYCPSMSKPDGWGVTKGARELMQQKEATTEQQLKELFQKQKF

SEQ ID NO: 2489 - protein, 419 aa, Meleagris gallopavo
MNKNQKPVLTGQRFKTRKRDEKEKFEPTVFRDTIVQGLNEAGSDLEAIAKFLDSAGSRLDYRRYADTLFDILVAGSMLAPGGTRIDDNDKTKMTRHCVFFAEEDHDAIRNYAQVFNKLIRRYKYLEKAFEDEIKKLLLFLKAFSETEQTKLAMLSGILLANGTLPATILTSLFTDNIVKEGIAASFAVKLFKAWMAEKDANSVTSALRKANLDKRLLELFPANRQNVDHFAKYFTEAGLKELSDFLRVQQSLGTRKELQKELQERLSQECPIKEMVLYVKEEMKRNELPEPAVIGLLWTCVMNAVEWNKKEELVAEQALKHLKQYAPLLAVFSTQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 2490 - protein, 650 aa, Meleagris gallopavo
NMLIFTQLFCSFQFSGLDLNSSDSQSEGTATSKGRYIPPHLRNREASKQGFDSGGWSSSRDKDAYSSFGARSDRGAKSSFFDRGNGSRGGRYEERGRGSDYDRSGFGRFDRGGNSRWCDKSDEDDWSKPLPPSERLEQELFSGSNTGINFEKYDDIPVEATGSNCPPHIESFSDVDMGEIIMGNIELTRYTRPTPVQKHAIPIIKEKRDLMACAQTGSGKTAAFLLPILSQIYADGPGDALRAMKENGRYGRRKQYPISLVLAPTRELAVQIYEEARKFAYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEELDKRSFLLDLLNATGKDSLTLVFVETKKGADALEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEQHHKGGGSRGRSKSSRFSGGFGARDYRTSSGAGSSSFNSSRSTSSRSGGSGSRGFGGGGYGGFYNSDGYGGNYNSQGVDWWGN

SEQ ID NO: 2491 - protein, 771 aa, Meleagris gallopavo
MAAAVRAIGSLGRFAAAAKYCPPRRPATEGYACRNVSTSTALQARTHVSYDIKGDVAVVRFNTPNSKVNTLSKQLNAEFTEVMNEIWANEAVKSAVLISSKPGSFIAGADIDMIAACKTSQEVTQLSQEGQKMLEKIEQSPKPIVAAISGSCLGGGLEVAIACHYRIATKDRKTILGTPEVLLGLLPGAGGTQRLPKMVGLPAAFDMMLTGRNIHADRAKKMGLVDQLVDPLGPGVKAPEARTIEYLEEVAIGFARGLANKTVSAKRSKGLVQKITDYAMALPFVRQQVYKTVESKVQKQTKGLYPAPLKIIEVVKAGLDQGRETGYLTESQNFGHLAMTNESKALIGLYHGQVRCKKNKFGAPQREVKTLAVLGAGLMGAGIAQVSVDKGLKTILKDTTQQGLDRGQQQVFKGLNGKVKKKSLTSFERDSILSNMTGQLDYKGFEKADMVIEAVFEDINIKHKVLKEVEAVIPPHCIFASNTSALPINQIAAVSQRPDKVIGMHYFSPVDKMQLLEIITTDKTSQDTAASAVAVGLKQGKVVIVVKDGPGFYTTRCLGPMLAEVGRVLQEGIDPKKVDAISTAFGFPVGAATLIDEVGVDVATHVAEDLGKAFGERFGGGSIGLFKLMVQKGFLAGRKAGKGFYIYQEGVKNRSLNSGMDEILAQFKLPAKPEVCTDEDIQMRLVTRFVNEAAMCLQEGILSNPVEGDIGAVFGLGFPPCLGGPFRYADSYGAKQLVDKLRKYEAVYGSQFTPCQLLLDYANSPGKKFHQ

SEQ ID NO: 2492 - protein, 1022 aa, Meleagris gallopavo
MSRRTAEMFQQAFLSTLLCVALVPLHAQFDDEPVTSCTEKTDCPISVYFVIDTSESIALQTVPIQSLVDQIKQFIPRFIEKLENEVYQNQVSITWMFGGLHYSDVVEIYSPLTRSKDTYLTKLRAINYLGRGTFTDCAISNMTQQFQSQTARDVKFAVVITDGHVTGSPCGGMKMQAERARDMGIKLFAVAPSEDVYEQGLREIASPPHDLYRSNYTITPKDALHIDENTIERIIKAMKHEAYAECYKMSCLEIAGPAGPKGYRGQKGAKGNMGEPGSPGLKGRQGDPGIEGPIGYPGPKGVPGLKGEKGEIGSDGRRGAAGLAGRNGTDGQKGKLGRIGPPGCKGDRGDKGPDGYPGDAGDQGERGDEGMKGDPGRPGRSGPPGPPGEKGSPGIPGNPGAQGPGGSKGRKGEIGPPGPKGEPGRRGDPGTKGSKGSPGTKGERGDPGPEGPRGLPGEVGNKGARGDQGLPGPRGPTGAVGEPGNIGSRGDPGDLGPRGDAGPPGPKGDRGRPGFSYPGPRGPQGDKGEKGQPGPKGGRGELGPKGTQGTKGEKGEPGDPGPRGEPGSRGPTGEAGPEGTPGPPGDPGLTDCDVMTYVRETCGCCDCEKRCGALDIMFVIDSSESIGYTNFTLEKNFVVNVVSRLGSIAKDPKSETGARVGVVQYSHEGTFEAIKLDDERINSLSSFKEAVKRLEWIAGGTWTPSALQFAYNKLIKESRREKAQVFAVVITDGRYDPRDDDKNLGALCGRDVLVNTIGIGDIFDQPEQSETLVSIACNEPQRVQKMRLFSDLVAEEFIDKMEDMLCPDPQIVCPELPCQTELAVAQCTQRPVDIVFLLDGSERIGEQNFHRAHHFVEQVAQQLTLARRNDDNMNARIALLQYGSESEQNVVFPLTYNLTEISNALAQIKYLDSSSNIGSAIIHAINNIVLSPGNGQRVARRNAELSFVFITDGITGSKNLEEAINSMKKQDVMPTVVALGSDVDMDVLLKLGLGDRAAIFREKDYESLSQPSFFDRFIRWIC

SEQ ID NO: 2493 - protein, 1213 aa, Meleagris gallopavo
SDVAVVDMSDISKQPSLFYHLGVRESFDMANNVILYHGTDDDTAQSLKDMVSQKNTASSGNYYFIPYIVTPCADYFCCESDAQRRASEYMQPSWDNILGPLCVPLVDRFISLLKDVHVTSCAYYKETLLNDIRKAREKYQGDELAKELARIKLRIDNTEVLTSDIVINLLLSYRDIQDYDAMVKLVETLEMLPTCDLADQHNIKFHYAFALNRRNNAGDREKALQVMLQVLQTCDHPAPDMFCLCGRIYKDMFLDSDCKDVNSRDHAIEWYRKGFELQSTLYSGINLAVLLLVEGQQFESSMELRKIGVRLNSLLGRKGSLEKMNNYWDVGQFFSVSMLANDVSKAVQAAEKLFKLKPPVWYLKSLVQNLMLIQRFKKFTIEHSPKQERLTFWLDIIFEATKETTNGLRFPVLVIEPTKVYQPAYVSINSEEDERSLSLWHVSPTEMKQIHEWNFAASSIRGISISKFDERCCFLYVHDNSDDFQIYFSTENQCSRFCGLVKEILSDAVGSTLELEGEIDGETLEYEYDYDEKGDRVVLGKGTYGIVYAGRDLSNQVRIAIKEIPERDSRYSQPLHEEIALHKYLKHRNVVQYLGSISEDGYIKIFMEQVPGGSLSALLRSKWGPMKEPTIKFYTKQILEGLKYLHENQIVHRDIKGDNVLVNTYSGVVKISDFGTSKRLAGINPCAETFTGTLQYMAPEIIDKGPRGYGAPADIWSLGCTMIEMATGKPPFHELGEPQAAMFKVGMFKIHPEIPESLSAEAKAFILLCFEPDPCKRATASDLLRDSFLKQVNKGKKSRIAFKPSDYNRNTSLPLSIHGEQAGSSSSEHGSVSPDSDVQHDVFFERPKRSISEIQTRHPIAHLLSVPDESLALEDRSFSPSSEDKDSGLFLLRKDSERRAILYKILKEEQNKVASNLQDCIAQSSEELQLSMAHIKQIIGILRDFIHSPEHRVMASTISKLKMDLDFDSTSINQIHLVLFGFQDAVNKVLRNHLIRPHWMFAMDNIIRRAVQAAVTILIPELRAHFEPASETEGGDKDCDEVEESFRPSEQNGTEDAAVTSGVSTLSSEVSHEAQQQLCLELGRLKQETIRLLEKLVQKEKEYQTLLQQSLEQKTQELHLLQLRFKPRVLLLFSVKDWQWPSSTLKENADPELTNWLKQQGADPDTIRRFAEEDYTLSTVLNDITKDDLRCLQLRGGLLCRIWNAILTHRQMP

SEQ ID NO: 2494 - protein, 499 aa, Oryza sativa
  source: /note="subsp. japonica"
MASINRPIVFFTVCLFLLCNGSLAQQLLGQSTSQWQSSRRGSPRECRFDRLQAFEPIRSVRSQAGTTEFFDVSNEQFQCTGVSVVRRVIEPRGLLLPHYTNGASLVYIIQGRGITGPTFPGCPESYQQQFQQSGQAQLTESQSQSQKFKDEHQKIHRFRQGDVIALPAGVAHWCYNDGEVPVVAIYVTDLNNGANQLDPRQRDFLLAGNKRNPQAYRREVEERSQNIFSGFSTELLSEALGVSSQVARQLQCQNDQRGEIVRVEHGLSLLQPYASLQEQEQGQVQSRERYQEGQYQQSQYGSGCSNGLDETFCTLRVRQNIDNPNRADTYNPRAGRVTNLNTQNFPILSLVQMSAVKVNLYQNALLSPFWNINAHSVVYITQGRARVQVVNNNGKTVFNGELRRGQLLIIPQHYAVVKKAQREGCAYIAFKTNPNSMVSHIAGKSSIFRALPNDVLANAYRISREEAQRLKHNRGDEFGAFTPIQYKSYQDVYNAAESS

SEQ ID NO: 2495 - protein, 499 aa, Oryza sativa
  source: /note="subsp. japonica"
MASINRPIVFFTVCLFLLCDGSLAQQLLGQSTSQWQSSRRGSPRGCRFDRLQAFEPIRSVRSQAGTTEFFDVSNELFQCTGVSVVRRVIEPRGLLLPHYTNGASLVYIIQGRGITGPTFPGCPETYQQQFQQSGQAQLTESQSQSHKFKDEHQKIHRFRQGDVIALPAGVAHWCYNDGEVPVVAIYVTDINNGANQLDPRQRDFLLAGNKRNPQAYRREVEEWSQNIFSGFSTELLSEAFGISNQVARQLQCQNDQRGEIVRVERGLSLLQPYASLQEQEQGQMQSREHYQEGGYQQSQYGSGCPNGLDETFCTMRVRQNIDNPNRADTYNPRAGRVTNLNSQNFPILNLVQMSAVKVNLYQNALLSPFWNINAHSIVYITQGRAQVQVVNNNGKTVFNGELRRGQLLIVPQHYVVVKKAQREGCAYIAFKTNPNSMVSHIAGKSSIFRALPTDVLANAYRISREEAQRLKHNRGDEFGAFTPLQYKSYQDVYNVAESS

SEQ ID NO: 2496 - protein, 499 aa, Oryza sativa
  source: /note="subsp. japonica"
MASSVFSRFSIYFCVLLLCHGSMAQLFNPSTNPWHSPRQGSFRECRFDRLQAFEPLRKVRSEAGVTEYFDEKNELFQCTGTFVIRRVIQPQGLLVPRYTNIPGVVYIIQGRGSMGLTFPGCPATYQQQFQQFSSQGQSQSQKFRDEHQKIHQFRQGDIVALPAGVAHWFYNDGDAPIVAVYVYDVNNNANQLEPRQKEFLLAGNNNRAQQQQVYGSSIEQHSGQNIFSGFGVEMLSEALGINAVAAKRLQSQNDQRGEIIHVKNGLQLLKPTLTQQQEQAQAQDQYQQVQYSERQQTSSRWNGLEENFCTIKVRVNIENPSRADSYNPRAGRITSVNSQKFPILNLIQMSATRVNLYQNAILSPFWNVNAHSLVYMIQGRSRVQVVSNFGKTVFDGVLRPGQLLIIPQHYAVLKKAEREGCQYIAIKTNANAFVSHLAGKNSVFRALPVDVVANAYRISREQARSLKNNRGEEHGAFTPRFQQQYYPGLSNESESETSE

SEQ ID NO: 2497 - protein, 495 aa, Oryza sativa
  source: /note="subsp. japonica"
MATTIFSRFSIYFCAMLLCQGSMAQLFNPSTNPWHSPRQGSFRECRFDRLQAFEPLRKVRSEAGVTEYFDEKNELFQCTGTFVIRRVIQPQGLLVPRYSNTPGLVYIIQGRGSMGLTFPGCPATYQQQFQQFSSQGQSQSQKFRDEHQKIHQFRQGDVVALPAGVAHWFYNDGDASVVAIYVYDINNSANQLEPRQKEFLLAGNNNRVQQVYGSSIEQHSSQNIFNGFGTELLSEALGINTVAAKRLQSQNDQRGEIVHVKNGLQLLKPTLTQQQEQAQAQYQEVQYSEQQQTSSRWNGLEENFCTIKARVNIENPSRADSYNPRAGRISSVNSQKFPILNLIQMSATRVNLYQNAILSPFWNVNAHSLVYMIQGQSRVQVVSNFGKTVFDGVLRPGQLLIIPQHYAVLKKAEREGCQYIAIKTNANAFVSHLAGKNSVFRALPVDVVANAYRISREQARSIKNNRGEEHGAFTPRFQQQYYPGFSNESESETSE

SEQ ID NO: 2498 - protein, 500 aa, Oryza sativa
  source: /note="subsp. japonica"
MATIAFSRLSIYFCVLLLCHGSMAQLFGPNVNPWHNPRQGGFRECRFDRLQAFEPLRRVRSEAGVTEYFDEKNEQFQCTGTFVIRRVIEPQGLLVPRYSNTPGMVYIIQGRGSMGLTFPGCPATYQQQFQQFLPEGQSQSQKFRDEHQKIHQFRQGDIVALPAGVAHWFYNEGDAPVVALYVFDLNNNANQLEPRQKEFLLAGNNNREQQMYGRSIEQHSGQNIFSGFNNELLSEALGVNALVAKRLQGQNDQRGEIIRVKNGLKLLRPAFAQQQEQAQQQEQAQAQYQVQYSEEQQPSTRCNGLDENFCTIKARLNIENPSHADTYNPRAGRITRLNSQKFPILNLVQLSATRVNLYQNAILSPFWNVNAHSLVYIVQGHARVQVVSNLGKTVFNGVLRPGQLLIIPQHYVVLKKAEHEGCQYISFKTNANSMVSHLAGKNSIFRAMPVDVIANAYRISREQARSLKNNRGEELGAFTPRYQQQTYPGFSNESENEALE

SEQ ID NO: 2499 - protein, 496 aa, Oryza sativa
  source: /note="subsp. japonica"
MATIKFPIVFSVVCLFLLCNGSLAQLLSQSTSQWQSSRRGSPRECRFDRLQAFEPIRTVRSQAGTTEFFDVSNELFQCTGVFVVRRVIEPRGLLLPHYSNGATLVYVIQGRGITGPTFPGCPETYQQQFQQSEQDQQLEGQSQSHKFRDEHQKIHRFQQGDVVALPAGVAHWCYNDGDAPIVAIYVTDIYNSANQLDPRHRDFFLAGNNKIGQQLYRYEARDNSKNVFGGFSVELLSEALGISSGVARQLQCQNDQRGEIVRVEHGLSLLQPYASLQEQQQEQVQSRDYGQTQYQQKQLQGSCSNGLDETFCTMRVRQNIDNPNLADTYNPRAGRITYLNGQKFPILNLVQMSAVKVNLYQNALLSPFWNINAHSVVYITQGRARVQVVNNNGKTVFDGELRRGQLLIIPQHHVVIKKAQREGCSYIALKTNPDSMVSHMAGKNSIFRALPDDVVANAYRISREEARRLKHNRGDELGVFTPSHAYKSYQDISVSA

SEQ ID NO: 2500 - protein, 820 aa, Oryza sativa
  source: /note="subsp. japonica"
MLCLTSSSSSAPAPLLPSLADRPSPGIAGGGGNVRLSVVSSPRRSWPGKVKTNFSVPATARKNKTMVTVVEEVDHLPIYDLDPKLEEFKDHFNYRIKRYLDQKCLIEKHEGGLEEFSKGYLKFGINTVDGATIYREWAPAAQEAQLIGEFNNWNGAKHKMEKDKFGIWSIKISHVNGKPAIPHNSKVKFRFRHGGGAWVDRIPAWIRYATFDASKFGAPYDGVHWDPPACERYVFKHPRPPKPDAPRIYEAHVGMSGEEPEVSTYREFADNVLPRIRANNYNTVQLMAIMEHSYYASFGYHVTNFFAVSSRSGTPEDLKYLVDKAHSLGLRVLMDVVHSHASNNVTDGLNGYDVGQNTHESYFHTGDRGYHKLWDSRLFNYANWEVLRFLLSNLRYWMDEFMFDGFRFDGVTSMLYHHHGINKGFTGNYKEYFSLDTDVDAIVYMMLANHLMHKLLPEATIVAEDVSGMPVLCRPVDEGGVGFDFRLAMAIPDRWIDYLKNKEDRKWSMSEIVQTLTNRRYTEKCIAYAESHDQSIVGDKTIAFLLMDKEMYTGMSDLQPASPTINRGIALQKMIHFITMALGGDGYLNFMGNEFGHPEWIDFPREGNNWSYDKCRRQWSLVDTDHLRYKYMNAFDQAMNALEEEFSFLSSSKQIVSDMNEKDKVIVFERGDLVFVFNFHPNKTYKGYKVGCDLPGKYRVALDSDALVFGGHGRVGHDVDHFTSPEGMPGVPETNFNNRPNSFKVLSPPRTCVAYYRVDEDREELRRGGAVASGKIVTEYIDVEATSGETISGGWKGSEKDDCGKKGMKFVFRSSDEDCK

SEQ ID NO: 2501 - protein, 484 aa, Oryza sativa
  source: /note="subsp. japonica"
MATTTSLLSSCLCALLLAPLFSQGVDAWESRQGASRQCRFDRLQAFEPLRKVRSEAGDTEYFDERNEQFRCAGVFVIRRVIEPQGLVVPRYSNTPALAYIIQGKGYVGLTFPGCPATHQQQFQLFEQRQSDQAHKFRDEHQKIHEFRQGDVVALPASVAHWFYNGGDTPAVVVYVYDIKSFANQLEPRQKEFLLAGNNQRGQQIFEHSIFQHSGQNIFSGFNTEVLSEALGINTEASKRLQSQNDQRGDIIRVKHGLQLLKPTLTQRQEEHRQYQQVQYREGQYNGLDENFCTIKARVNIENPSRADYYNPRAGRITLLNNQKFPILNLIGMGAARVNLYQNALLSPFWNINAHSVVYIIQGSVRVQVANNQGRSVFNGVLHQGQLLIIPQNHAVIKKAEHNGCQYVAIKTISDPTVSWVAGKNSILRALPVDVIANAYRISRDEARRLKNNRADEIGPFTPRFPQKSQRGYQFLTEGLSLIGM

SEQ ID NO: 2502 - protein, 510 aa, Oryza sativa
  source: /note="subsp. japonica"
MASMSTILPLCLGLLLFFQVSMAQFSFGGSPLQSPRGFRGDQDSRHQCRFEHLTALEATHQQRSEAGFTEYYNIEARNEFRCAGVSVRRLVVESKGLVLPMYANAHKLVYIVQGRGVFGMALPGCPETFQSVRSPFEQEVATAGEAQSSIQKMRDEHQQLHQFHQGDVIAVPAGVAHWLYNNGDSPVVAFTVIDTSNNANQLDPKRREFFLAGKPRSSWQQQSYSYQTEQLSRNQNIFAGFSPDLLSEALSVSKQTVLRLQGLSDPRGAIIRVENGLQALQPSLQVEPVKEEQTQAYLPTKQLQPTWLRSGGACGQQNVLDEIMCAFKLRKNIDNPQSSDIFNPHGGRITRANSQNFPILNIIQMSATRIVLQNNALLTPHWTVNAHTVMYVTAGQGHIQVVDHRGRSVFDGELHQQQILLIPQNFAVVVKARREGFAWVSFKTNHNAVDSQIAGKASILRALPVDVVANAYRLSREDSRHVKFNRGDEMAVFAPRRGPQQYAEWQINEK

SEQ ID NO: 2503 - protein, 495 aa, Oryza sativa
  source: /note="subsp. japonica"
AFSRFSICFCVLLLCHGSMAQIFSLGINPWQNPRQGGSRECRFDRLQAFEPLRKVRHEAGVTEYFDEKNEQFQCTGTLVIRRIIEPQGLLLPRYSNTPGLVYIIQGTGVLGLTFPGCPATYQKQFRHFGLEGGSQRQGKKLRDENQKIHQFRQGDVVALPSGIPHWFYNEGDTPVVALFVFDVNNNANQLEPRQKEFLLAGNNIEQQVSNPSINKHSGQNIFNGFNTKLLSEALGVNIEVTRRLQSQNDRRGDIIRVKNGLRLIKPTITQQQEQTQDQYQQIQYHREQRSTSKYNGLDENFCAIRARLNIENPNHADTYNPRAGRITNLNSQKFSILNLVQMSATRVNLYQNAILSPFWNINAHSLVYTIQGRARVQVVSNHGKAVFNGVLRPGQLLIIPQNYVVMKKAELEGFQFIAFKTNPNAMVNHIAGKNSVLRAMPVDVIANAYRISRQEARSLKNNRGEEIGAFTPRYQQQKIHQEYSNPNESETQEVI

SEQ ID NO: 2504 - protein, 825 aa, Oryza sativa
  source: /note="subsp. japonica"
MAAPASAVPGSAAGLRAGAVRFPVPAGARSWRAAAELPTSRSLLSGRRFPGAVRVGGSGGRVAVRAAGASGEVMIPEGESDGMPVSAGSDDLQLPALDDELSTEVGAEVEIESSGASDVEGVKRVVEELAAEQKPRVVPPTGDGQKIFQMDSMLNGYKYHLEYRYSLYRRLRSDIDQYEGGLETFSRGYEKFGFNHSAEGVTYREWAPGAHSAALVGDFNNWNPNADRMSKNEFGVWEIFLPNNADGSSPIPHGSRVKVRMETPSGIKDSIPAWIKYSVQAAGEIPYNGIYYDPPEEEKYIFKHPQPKRPKSLRIYETHVGMSSTEPKINTYANFRDEVLPRIKKLGYNAVQIMAIQEHAYYGSFGYHVTNFFAPSSRFGTPEDLKSLIDKAHELGLVVLMDVVHSHASNNTLDGLNGFDGTDTHYFHSGSRGHHWMWDSRLFNYGNWEVLRFLLSNARWWLEEYKFDGFRFDGVTSMMYTHHGLQVAFTGNYSEYFGFATDADAVVYLMLVNDLIHGLYPEAITIGEDVSGMPTFALPVQDGGVGFDYRLHMAVPDKWIELLKQSDESWKMGDIVHTLTNRRWSEKCVTYAESHDQALVGDKTIAFWLMDKDMYDFMALDRPATPSIDRGIALHKMIRLITMGLGGEGYLNFMGNEFGHPEWIDFPRAPQVLPNGKFIPGNNNSYDKCRRRFDLGDADYLRYRGMLEFDRAMQSLEEKYGFMTSDHQYISRKHEEDKMIIFEKGDLVFVFNFHWSNSYFDYRVGCLKPGKYKVVLDSDAGLFGGFGRIHHTAEHFTADCSHDNRPYSFSVYSPSRTCVVYAPAE

SEQ ID NO: 2505 - protein, 954 aa, Oryza sativa
  source: /note="subsp. japonica"
MAVGEECAAAVASQVRHRWLAAAFFSSVDVAIVAGLPRVPTNYRDAPTCGMWGPHVSRCFIATFFNKPLGVLLGFVTDARAYWVTRSLIAWNVNDQDTSLFLYASRDATMHVSDGAIHGYDSKIELEPEHASLPDNVAEKFPFIRSYRTFRVPSSVDVASLVKCQLAVASYDAHGRHQDVTGLQLPGVLDDMFAYTGPLGAVFSDKDVDLYLWAPTAQDVRVCFYDGPAGPLLQTVQLKELNGVWSVTVPRYRENQYYLYEVKVYHPSTSQVEKCLADDPYARGLSANGTRTWLVDINSETLKPASWDELSDEKPNLESFSDISIYELHIRDFSAHDSTVDCNSRGGFRAFTFQDSAGIRHLRKLSAAGLTHVHLLPSFHFASVDDNKSNWKFVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLIVDDLLNWAINYKVDGFRFDLMGHIMKSTMIRAKSAIRSLTRDVHGVDGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPLKNHILSVFDNFVDILKIRYSSPLFRLSTASDIEQRVRFHNTGPSMVPGVIVMSIKDAQNEKCKMAQLDKNFSYVVTIFNVCPHEVSIEIHDLASLGLELHPIQVNSSDALVRQSAYEASKGRFTVPRRTTAVFVQPRC

SEQ ID NO: 2506 - protein, 609 aa, Oryza sativa
  source: /note="subsp. japonica"
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAALEAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 2507 - protein, 947 aa, Oryza sativa
  source: /note="subsp. japonica"
MPSVSRAVCVQRASGNNGRRCRDGAAAAGRRSVVAQRARHGKPEVAIRSGSGGSARGGHCSPLRAVAAPIPTTKKRVFHFGKGKSEGNKAMKDLLGGKGANLAEMASIGLSVPPGFTVSTEACQQYQAAGKTLPAGLWEEIVEGLQWVEEYMAARLGDPARPLLLSVRSGAAVSMPGMMDTVLNLGLNDEVAAGLAAKSGDRFAYDSYRRFLDMFGNVVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 2508 - protein, 816 aa, Oryza sativa
  source: /note="subsp. japonica"
MGETTGERALTRLHSMRERIGDSLSAHTNELVAVFSRLVNQGKGMLQPHQIIAEYNAAIPEGEREKLKDSALEDVLRGAQEAIVIPPWIALAIRPRPGVWEYLRINVSQLGVEELSVPEYLQFKEQLVDGSTQNNFVLELDFEPFNASFPRPSLSKSIGNGVQFLNRHLSSKLFHDKESMYPLLNFLRAHNYKGMTMMLNDRIRSLDALQGALRKAEKHLAGITADTPYSEFHHRFQELGLEKGWGDCAQRVRETIHLLLDLLEAPEPSALEKFLGTIPMVFNVVILSPHGYFAQANVLGYPDTGGQVVYILDQVRAMENEMLLRIKQQGLNITPRILIVTRLLPDAHGTTCGQRLEKVLGTEHTHILRVPFRTENGTVRKWISRFEVWPYLETYTDDVAHEISGELQATPDLIIGNYSDGNLVACLLAHKLGVTHCTIAHALEKTKYPNSDLYWKKFEDHYHFSCQFTADLIAMNHADFIITSTFQEIAGNKETVGQYESHMAFTMPGLYRVVHGIDVFDPKFNIVSPGADMSIYFPFTESQKRLTSLHLEIEELLFSDVENTEHKFVLKDKKKPIIFSMARLDHVKNLTGLVELYGRNPRLQELVNLVVVCGDHGKESKDKEEQAEFKKMFNLIEQYNLNGHIRWISAQMNRVRNGELYRYICDMRGAFVQPALYEAFGLTVIEAMTCGLPTFATAYGGPAEIIVHGVSGYHIDPYQNDKASALLVEFFEKCQEDPNHWIKISQGGLQRIEEKYTWKLYSERLMTLSGVYGFWKYVTNLDRRETRRYLEMLYALKYRKMATTVPLAIEGEASTK

SEQ ID NO: 2509 - protein, 514 aa, Oryza sativa
  source: /note="subsp. japonica"
MPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKDGTVI

SEQ ID NO: 2510 - protein, 514 aa, Oryza sativa
  source: /note="subsp. japonica"
MAMAAAMGVASPYHAAHAAASTSCDSLRLLVAEGRPRRPRGVASSSSSSSSAGRRRRPLVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLPSGTVI

SEQ ID NO: 2511 - protein, 808 aa, Oryza sativa
  source: /note="subsp. japonica"
MAAKLARLHSLRERLGATFSSHPNELIALFSRYVNQGKGMLQRHQLLAEFDALIEADKEKYAPFEDILRAAQEAIVLPPWVALAIRPRPGVWDYIRVNVSELAVEELSVSEYLAFKEQLVDGHTNSNFVLELDFEPFNASFPRPSMSKSIGNGVQFLNRHLSSKLFQDKESLYPLLNFLKAHNHKGTTMMLNDRIQSLRGLQSSLRKAEEYLMGIPQDTPYSEFNHRFQELGLEKGWGDCAKRVLDTIHLLLDLLEAPDPANLEKFLGTIPMMFNVVILSPHGYFAQSNVLGYPDTGGQVVYILDQVRALENEMLLRIKQQGLDITPKILIVTRLLPDAVGTTCGQRVEKVIGTEHTDILRVPFRSENGILRKWISRFDVWPFLETYTEDVANEIMREMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYFPYTEADKRLTAFHPEIEELLYSEVENDEHKFVLKDKNKPIIFSMARLDRVKNMTGLVEMYGKNAHLRDLANLVIVCGDHGNQSKDREEQAEFKKMYGLIDQYKLKGHIRWISAQMNRVRNGELYRYICDTKGVFVQPAFYEAFGLTVIEAMTCGLPTIATCHGGPAEIIVDGVSGLHIDPYHSDKAADILVNFFEKCKQDSTYWDNISQGGLQRIYEKYTWKLYSERLMTLTGVYGFWKYVSNLERRETRRYIEMFYALKYRSLASAVPLAVDGESTSK

SEQ ID NO: 2512 - protein, 809 aa, Oryza sativa
  source: /note="subsp. japonica"
MSGPKLDRTPSIRDRVEDTLHAHRNELVALLSKYVSQGKGILQPHHILDALDEVQSSGGRALVEGPFLDVLRSAQEAIVLPPFVAIAVRPRPGVWEYVRVNVHELSVEQLTVSEYLRFKEELVDGQYNDPYILELDFEPFNASVPRPNRSSSIGNGVQFLNRHLSSIMFRNKDCLEPLLDFLRGHRHKGHVMMLNDRIQSLGRLQSVLTKAEEHLSKLPADTPYSQFAYKFQEWGLEKGWGDTAGYVLEMIHLLLDVLQAPDPSTLETFLGRIPMIFNVVVVSPHGYFGQANVLGLPDTGGQIVYILDQVRALENEMVLRLKKQGLDFTPKILIVTRLIPEAKGTSCNQRLERISGTQHTYILRVPFRNENGILRKWISRFDVWPYLEKFAEDAAGEIAAELQGTPDFIIGNYSDGNLVASLLSYKMGITQCNIAHALEKTKYPDSDIYWTKYDEKYHFSCQFTADIIAMNNADFIITSTYQEIAGSKNTVGQYESHTAFTLPGLYRIVHGIDVFDPKFNIVSPGADMSIYFPYTEKAKRLTSLHGSLENLISDPEQNDEHIGHLDDRSKPILFSMARLDRVKNITGLVEAYAKNARLRELVNLVVVAGYNDVKKSKDREEIAEIEKMHELIKTYNLFGQFRWISAQTNRARNGELYRYIADTHGAFVQPAFYEAFGLTVVEAMTCGLPTFATVHGGPAEIIEHGISGFHIDPYHPDQAANLIADFFEQCKQDPNHWVEVSNRGLQRIYEKYTWKIYSERLMTLAGVYGFWKYVSKLERRETRRYLEMFYILKFRELAKTVPLAVDEAH

SEQ ID NO: 2513 - protein, 150 aa, Oryza sativa
  source: /note="subsp. japonica"
MKIIFVFALLAIAACSASAQFDVLGQSYRQYQLQSPVLLQQQVLSPYNEFVRQQYGIAASPFLQSAAFQLRNNQVWQQLALVAQQSHYQDINIVQAIAQQLQLQQFGDLYFDRNLAQAQALLAFNVPSRYGIYPRYYGAPSTITTLGGVL

SEQ ID NO: 2514 - protein, 951 aa, Oryza sativa
  source: /note="subsp. japonica"
MATASAPLQLATASRPLPVGVGCGGGGGGGLHVGGARGGGAAPARRRLAVRSVASDRGVQGSVSPEEEISSVLNSIDSSTIASNIKHHAEFTPVFSPEHFSPLKAYHATAKSVLDTLIMNWNATYDYYDRTNVKQAYYLSMEFLQGRALTNAVGNLELTGQYAEALQQLGHSLEDVATQEPDAALGNGGLGRLASCFLDSLATLNYPAWGYGLRYKHGLFKANHTKDGQEEVAENWLEMGNPWEIVRTDVSYPVKFYGKVVEGTDGRMHWIGGENIKVVAHDIPIPGYKTKTTNNLRLWSTTVPSQDFDLEAFNAGDHASAYEAHLNAEKPHYRDIIARFERRAGDSLSWEDFPSKVAVQMNDTHPTLCIPELMRILIDVKGLSWNEAWSITERTVAYTNHTVLPEALEKWSLDIMQKLLPRHVEIIEKIDGELMNIIISKYGTEDTSLLKKKIKEMRILDNIDLPDSIAKLFVKPKEKKESPAKLKEKLLVKSLEPSVVVEEKTVSKVEINEDSEEVEVDSEEVVEAENEDSEDELDPFVKSDPKLPRVVRMANLCVVGGHSVNGVAAIHSEIVKEDVFNSFYEMWPAKFQNKTNGVTPRRWIRFCNPELSAIISKWIGSDDWVLNTDKLAELKKFADDEDLQSEWRAAKKANKVKVVSLIREKTGYIVSPDAMFDVQVKRIHEYKRQLLNILGIVYRYKKMKEMSAKDRINSFVPRVCIFGGKAFATYVQAKRIVKFITDVAATVNHDPEIGDLLKVVFIPDYNVSVAEALIPASELSQHISTAGMEASGTSNMKFAMNGCILIGTLDGANVEIREEVGEENFFLFGAEAHEIAGLRKERAQGKFVPDPRFEEVKRFVRSGVFGTYNYDDLMGSLEGNEGYGRADYFLVGKDFPSYIECQEKVDKAYRDQKLWTRMSILNTASSSKFNSDRTIHEYAKDIWDIKPVILP

SEQ ID NO: 2515 - protein, 665 aa, Oryza sativa
  source: /note="subsp. japonica"
MDRVRGCAFLLGVLLAGSLFAFSVAKEETKKLGTVIGIDLGTTYSCVGVYKNGHVEIIANDQGNRITPSWVAFTDSERLIGEAAKNQAAVNPERTIFDVKRLIGRKFEDKEVQRDMKLVPYKIVNKDGKPYIQVKIKDGENKVFSPEEVSAMILGKMKETAEAYLGKKINDAVVTVPAYFNDAQRQATKDAGVIAGLNVARIINEPTAAAIAYGLDKKGGEKNILVFDLGGGTFDVSILTIDNGVFEVLATNGDTHLGGEDFDQRIMEYFIKLIKKKYSKDISKDNRALGKLRREAERAKRALSNQHQVRVEIESLFDGTDFSEPLTRARFEELNNDLFRKTMGPVKKAMDDAGLEKSQIHEIVLVGGSTRIPKVQQLLRDYFEGKEPNKGVNPDEAVAYGAAVQGSILSGEGGDETKDILLLDVAPLTLGIETVGGVMTKLIPRNTVIPTKKSQVFTTYQDQQTTVSIQVFEGERSMTKDCRLLGKFDLSGIPAAPRGTPQIEVTFEVDANGILNVKAEDKGTGKSEKITITNEKGRLSQEEIDRMVREAEEFAEEDKKVKERIDARNQLETYVYNMKNTVGDKDKLADKLESEEKEKVEEALKEALEWLDENQTAEKEEYEEKLKEVEAVCNPIISAVYQRTGGAPGGGADGEGGVDDEHDEL

SEQ ID NO: 2516 - protein, 407 aa, Oryza sativa
  source: /note="subsp. japonica"
MASSSVFAGLAQAPEDPILGVTVAYNKDPSPVKVNLGVGAYRTEEGKPLVLNVVRRAEQMLINNPSRVKEYLPITGLADFNKLSAKLIFGADSPAIQENRVATVQCLSGTGSLRVGGEFLARHYHERTIYIPQPTWGNHPKVFTLAGLTVRSYRYYDPATRGLDFQGLLEDLGSAPSGAIVLLHACAHNPTGVDPTLDQWEQIRQLMRSKALLPFFDSAYQGFASGSLDQDAQSVRMFVADGGELLMAQSYAKNMGLYGERVGALSIVCGSADVAVRVESQLKLVIRPMYSNPPIHGASIVATILKDSAMFNEWTVELKGMADRIISMRQQLFDALKTRETPGDWSHIIKQIGMFTFTGLNSDQVAFMRQEYHIYMTSDGRISMAGLSGRTIPHLADAIHAAVTKLK

SEQ ID NO: 2517 - protein, 337 aa, Oryza sativa
  source: /note="subsp. japonica"
MGKIKIGINGFGRIGRLVARVALQSEDVELVAVNDPFITTEYMTYMFKYDTVHGQWKHHEVKVKDSKTLIFGTKEVAVFGCRNPEEIPWAAAGAEYVVESTGVFTDKDKAAAHLKGGAKKVVISAPSKDAPMFVVGVNEKEYKSDVNIVSNASCTTNCLAPLAKVINDRFGIVEGLMTTVHAITATQKTVDGPSMKDWRGGRAASFNIIPSSTGAAKAVGKVLPALNGKLTGMAFRVPTVDVSVVDLTVRLEKPASYDQIKAAIKEEAEGKLKGILGYVEEDLVSTDFQGDSRSSIFDAKAGIALSDTFVKLVSWYDNEWGYSTRVIDLIRHMHSTN

SEQ ID NO: 2518 - protein, 425 aa, Oryza sativa
  source: /note="subsp. japonica"
MAAMMAVTTMVTRNNAVGGGAVAVVDRKGWFVPEVSFPWSSVEGECINSSSKRLEFPRRTAAPPLFASVGLSLPSAAKGRDNCDVARQLAAAEAEEAAGKKRQGRKMKGGGGLLSLRKVRVKIGNPHLRRLVSGAIAGAVSRTFVAPLETIRTHLMVGSCGAGSMAEVFRWIMRTEGWTGLFRGNAVNVLRVAPSKAIEHFTYDTAKKYLTPEDGEPAKIPIPVPLVAGALAGVASTLCTYPMELVKTRLTIEKDVYDNVLHAFVKIVREGGPGELYRGLAPSLIGVVPYAATNFYAYETLRRLYRRATGRADVGPAATLLIGSAAGAIASTATFPLEVARKQMQVGAVGGRQVYRHVLHAMYCILRGEGAAGLYRGLGPSCIKLMPAAGISFMCYEALKKVLVEEEAAPELEAECAEEIKEKVA

SEQ ID NO: 2519 - protein, 562 aa, Oryza sativa
  source: /note="subsp. japonica"
MATRARATILLLLAAVLFAAAAAASGEDRRRETSLRRCLQRCEQDRPPYERARCVQECKDQQQQQQERRREHGGHDDDRRDRDRRGEGSSEEEDEGRERGSRRRPYVFGRRSFRQVVRSDQGSVRLLPPFHQASSLLRGIKNYRVAVLEANPRSFVMPTHTDAHCICYVAQGEGVVAIIENGEKWSYAIRQGDVFVAPAGTINYLANTDGRRKLIVTKILHTISVPGQIQFFFAPGGRNPESFLSSFSKGVQRAAFKISEEKLEKLLGKQDKGVIIRASEEQVRELRRHASEGGHGPHWPLPPFGESSRGPFNILEQRPRFANRHGRLYEADARSFHDLAEHDIRVAVVNITAGSMNAPFYNTRSVKVAYVLDGEGEAEIVCPHLSRGGRGGESEERRRERGKGKWREEEEEEEEQQKGQEEEEEEQVGQGYETIRARLSRGTVFVVPSGHPIVVTSSRDSTLQIVCFDVHANNNERMYLAGMNSVLKKLDPQAKELAFAASAREVDELLNAQQESAFLAGPEKSGRRGEESEDEDRRRRRSHRGRGDEAVETLLRMAAAAV

SEQ ID NO: 2520 - protein, 698 aa, Oryza sativa
  source: /note="subsp. japonica"
MASFTSQLGAMACGAAPSTSPLAARRSGQLFVGRKPAAASVQMRVPRAGRARGVAMRVACEKVVGIDLGTTNSAVAAMEGGKPTVITNAEGQRTTPSVVAYTKGGERLVGQIAKRQAVVNPENTFFSVKRFIGRKMAEVDDEAKQVSYHVVRDDNGNVKLDCPAIGKQFAAEEISAQVLRKLVDDASKFLNDKITKAVVTVPAYFNDSQRTATKDAGRIAGLEVLRIINEPTAASLAYGFEKKNNETILVFDLGGGTFDVSVLEVGDGVFEVLSTSGDTHLGGDDFDKKVVDWLASNFKKDEGIDLLKDKQALQRLTEAAEKAKMELSTLSQTNISLPFITATADGPKHIETTLSRAKFEELCSDLIDRLKTPVTNALRDAKLSVDNLDEVILVGGSTRIPSVQELVKKITGKDPNVTVNPDEVVSLGAAVQGGVLAGDVKDVVLLDVTPLSLGLETLGGVMTKIIPRNTTLPTSKSEVFSTAADGQTSVEINVLQGEREFVRDNKSLGSFRLDGIPPAPRGVPQIEVKFDIDANGILSVAAIDKGTGKKQDITITGASTLPKDEVERMVEEADKFAQEDKEKRDAIDTKNQADSVVYQTEKQLKELGDKVPAPVKEKVDAKLNELKEAIAGGSTQSMKDAMAALNEEVMQIGQAMYNQQPNAGAAGPTPGADAGPTSSGGKGPNDGDVIDADFTDSN

SEQ ID NO: 2521 - protein, 817 aa, Oryza sativa
  source: /note="subsp. japonica"
MALTSQSLFFSPLAAGPSRRVRGRGRSTSVSAAASASSHNSQPHGHPQQPLAVASSSSKSESKGSKTFALASAITAAASGAFLLASSGGGFGGGAGGPLGGGGGGWGAGGGGGGGGGGGGGGFWSRIFSGGAAHADEKSSGDWDPHGLPANINVPMTKLSGLKRYKISELKFFDRAAGGGGAFTGPEDSFFEMVTLQPGGVYTKSQLLKELETLVSCGMFERVDLEGKAKPDGTLGLTVSFVESVWSAAKQFKCINVGLMSQSGQVDFDQDMTEREKMDYLRKQERDYQQRVRGAKPCILPDNVRGEVLGMMKKQEKVSARLLQRIRDHVQKWYHNEGFVCAQVVNFGNLNTSEVVCEVVEGDITKVEYQFQDKLGNFVEGNTQIPIIDRELPQQLRPGHIFNIGAGKQALKNINSLALFSNIEVNPRPDETKEGGIVVEIKLKELEPKSAEVSTEWSIVPGREGRPTLASIQPGGTVSFEHRNIYGLNRSIVGSVTSSNLLNPQDDLSFKLEYVHPYLDGVDDRNKNRTFKTSCFNTRKLSPVFVAGPNMDEAPPVWVDRVGFKANITESFTRQSKFTYGLVVEEITTRDETNSICTHGSRAMPSGGLSMDGPPTTLSGTGIDRMAFLQANITRDNTEFVNGAVIGDRCIFQLDQGLGIGSKNPFFNRHQLTLTKFVNLNKQEKGAGKPLPAVLVLHGHYAGCVGDLPSYDAFTLGGPYSVRGYGMGELGASRNVLEVASELRIPVRNTYVYGFVEHGTDLGSSKDVKGNPTEFFRRVGHGSSYGLGVKLGLVRGEYIVDHNAGTGTVFFRFGERF

SEQ ID NO: 2522 - protein, 447 aa, Oryza sativa; identical to SEQ ID NO: 767
  source: /note="subsp. japonica"

SEQ ID NO: 2523 - protein, 495 aa, Oryza sativa
  source: /note="subsp. japonica"
MTISVFSRFSIYFCVLLLCNGSMAQLFDPATNQWQTHRQGSFRECRFERLQAFEPLQNVRSEAGVTEYFDETNELFQCTGTFVIRRVIQPQGLLIPRYANTPGMVYIIQGRGSMGLTFPGCPATYQQQSQQFLFQGESQSQKFIDEHQKIHQFRQGDIVVLPTGVAHWFYNDGDTPVVALYVYDINNSANQLEPRHREFLLAGKNNRVQQVYGRSIQQHSGQNIFNGFSVEPLSEALNINTVTTKRLQSQNDQRGEIIHVKNGLQLLKPTLTQRQEQEQAQYQEVQYSEKPQTSSRWNGLEENLCTIKTRLNIENPSRADSYDPRAGRITSLDSQKFPILNIIQMSATRVNLYQNAILTPFWNVNAHSLMYVIRGRARVQVVSNFGKTVFDGVLRPEQLLIIPQNYVVLKKAQHEGCQYIAINTNANAFVSHLAGVDSVFHALPVDVIANAYCISREEARRLKNNRGDEYGPFPPRLQQQIYPEFSNESKGETSE

SEQ ID NO: 2524 - protein, 186 aa, Oryza sativa
  source: /note="subsp. japonica"
MASKVVFFAAALMAAMVAISGAQLSESEMRFRDRQCQREVQDSPLDACRQVLDRQLTGRERFQPMFRRPGALGLRMQCCQQLQDVSRECRCAAIRRMVRSYEESMPMPLEQGWSSSSSEYYGGEGSSSEQGYYGEGSSEEGYYGEQQQQPGMTRVRLTRARQYAAQLPSMCRVEPQQCSIFAAGQY

SEQ ID NO: 2525 - protein, 358 aa, Oryza sativa
  source: /note="subsp. japonica"
MSAYCGKYKDELIKNAAYIGTPGKGILAADESTGTIGKRFASINVENVEENRRSLRELLFTTPGALQHLSGVILFEETLYQKTKDGKPFVDVLKEGGVLPGIKVDKGTVEVAGTNKETTTQGHDDLGKRCAKYYEAGARFAKWRAVLKIGPNEPSQLSIDLNAQGLARYAIICQENGLVPIVEPEILVDGSHDIERCAYVTEKVLAACYKALNEHHVLLEGSLLKPNMVTPGSESKKVSPQLIAEYTVRALQRTVPAAVPAIVFLSGGQSEEEATVNLNAMNKLSTKKPWALSFSFGRALQQSTLKAWGGKTENVVKAQKAFITRCKANSEATLGTYQGDAVLGEGASESLHVKDYKY

SEQ ID NO: 2526 - protein, 369 aa, Oryza sativa
  source: /note="subsp. japonica"
MGKGGKGAEAAAAAVAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQIVHPGDLCFKLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 2527 - protein, 483 aa, Oryza sativa
  source: /note="subsp. japonica"
MAAPSVAVDNLNPKVLNCEYAVRGEIVIHAQRLQQQLQTQPGSLPFDEILYCNIGNPQSLGQKPVTFFREVIALCDHPCLLEKEETKSLFSADAISRATTILASIPGRATGAYSHSQGIKGLRDAIAAGIASRDGYPANADDIFLTDGASPGVHMMMQLLIRNEKDGILCPIPQYPLYSASIALHGGALVPYYLNESTGWGLEISDLKKQLEDSRLKGIDVRALVVINPGNPTGQVLAEENQRDIVKFCKNEGLVLLADEVYQENIYVDNKKFNSFKKIARSMGYNEDDLPLVSFQSVSKGYYGECGKRGGYMEITGFSAPVREQIYKVASVNLCSNITGQILASLVMNPPKAGDASYASYKAEKDGILQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 2528 - protein, 512 aa, Oryza sativa
  source: /note="subsp. japonica"
MAISKAWISLLLALAVVLSAPAARAEEAAAAEEGGDAAAEAVLTLDADGFDEAVAKHPFMVVEFYAPWCGHCKKLAPEYEKAAQELSKHDPPIVLAKVDANDEKNKPLATKYEIQGFPTLKIFRNQGKNIQEYKGPREAEGIVEYLKKQVGPASKEIKSPEDATNLIDDKKIYIVGIFSELSGTEYTNFIEVAEKLRSDYDFGHTLHANHLPRGDAAVERPLVRLFKPFDELVVDSKDFDVTALEKFIDASSTPKVVTFDKNPDNHPYLLKFFQSSAAKAMLFLNFSTGPFESFKSVYYGAAEEFKDKEIKFLIGDIEASQGAFQYFGLREDQVPLIIIQDGESKKFLKAHVEPDQIVSWLKEYFDGKLSPFRKSEPIPEVNDEPVKVVVADNVHDFVFKSGKNVLVEFYAPWCGHCKKLAPILDEAATTLKSDKDVVIAKMDATANDVPSEFDVQGYPTLYFVTPSGKMVPYESGRTADEIVDFIKKNKETAGQAKEKAESAPAEPLKDEL

SEQ ID NO: 2529 - protein, 166 aa, Oryza sativa
  source: /note="subsp. japonica"
MASNKVVFSALLLIIVSVLAATATMADHHKDQVVYSLGERCQPGMGYPMYSLPRCRAVVKRQCVGHGAPGGAVDEQLRQDCCRQLAAVDDSWCRCSALNHMVGGIYRELGATDVGHPMAEVFPGCRRGDLERAAASLPAFCNVDIPNGTGGVCYWLGYPRTPRTGH

SEQ ID NO: 2530 - protein, 337 aa, Oryza sativa
  source: /note="subsp. japonica"
MAKIKIGINGFGRIGRLVARVALQSDDVELVAVNDPFITTDYMTYMFKYDTVHGQWKHHEVKVKDSKTLLFGEKEVTVFGCRNPEEIPWGETGAEFVVESTGVFTDKDKAAAHLKGGAKKVVISAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKEESEGKLKGILGYVEEDLVSTDFQGDNRSSIFDAKAGIALNDNFVKLVSWYDNEWGYSSRVVDLIRHMYNTQ

SEQ ID NO: 2531 - protein, 470 aa, Oryza sativa
  source: /note="subsp. japonica"
MAKKKTSSSMARSQLAALLISLCFLSLASNAVGWSRRGEREEEDERRRHGGEGGRPYHLGEESFRHWTRTRHGRFSVLERFPDEQVVGAAVGGYRVAVLEAAPRAFLQPSHYDADEVFYVKEGEGVIVLLREGRRESFCVREGDAMVIPAGAIVYSANTHSSKWFRVVMLLNPVSTPGHFEEYFPVGGDRPESFFSAFSDDVLQAAFNTRREELEKVFERQREGGEITTAPEEQIRELSKSCSRGGGGGSGSEWEIKPSSLTGKSPYFSNNHGKLFELTGDECRHLKKLDLQIGLANITRGSMIAPNYNTRATKLAVVLQGSGYFEMACPHVSGGGSSERREREREHGRRREEEQGEEEHGERGEKARRYHKVRAQVREESVIVIPASHPATIVASEGESLAVVCFFVGANHDEKVFLAGRNSPLRQLDDPAKKLVFGGSAAREADRVLAAQPEQILLRGPHGRGSVSDM

SEQ ID NO: 2532 - protein, 843 aa, Oryza sativa
  source: /note="subsp. japonica"
MVKFTVEELRRIMDKKNNIRNMSVIAHVDHGKSTLTDSLVAAAGIIAQEVAGDVRMTDTRADEAERGITIKSTGISLFYEMSDESLKLYKGERDGNEYLINLIDSPGHVDFSSEVTAALRITDGALVVVDCIEGVCVQTETVLRQALGERIRPVLTVNKMDRCFLELQVEGEEAYQTFSRVIENANVIMATYEDTLLGDVQVYPEKGTVAFSAGLHGWAFTLSSFAKMYASKFGVDEFKMMERLWGENFFDPATKKWTNKNTGSATCKRGFVQFCYEPIKQIINTCMNDQKDKLWPMLQKLGVVMKADEKELMGKALMKRVMQTWLPASNALLEMMIYHLPSPSKAQRYRVENLYEGPLDDVYATAIRNCDPEGPLMLYVSKMIPASDKGRFFAFGRVFSGRVATGMKVRIMGPNYVPGQKKDLYVKSVQRTVIWMGKKQESVEDVPCGNTVAMVGLDQFITKNATLTNEKESDACPIRAMKFSVSPVVRVAVQCKVASDLPKLVEGLKRLAKSDPMVLCTIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMTSDPLEAGSQASTLVQDIRKRKGLKEQMTPLSDFEDKL

SEQ ID NO: 2533 - protein, 414 aa, Oryza sativa
  source: /note="subsp. japonica"
MAGMAPEGSQFDAKHYDSKMQELLNQGETEEFFTSYDEVHESFDDMGLQENLLRGIYAYGFEKPSAIQQRGIVPFCKGLDVIQQAQSGTGKTATFCSGILQQLDYAVVECQALVLAPTRELAQQIEKVMRALGDYLGVKVHACVGGTSVREDQRILASGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPANVADLL

SEQ ID NO: 2534 - protein, 414 aa, Oryza sativa
  source: /note="subsp. japonica"
MAGMAPEGSQFDAKHYDSKMQELLHQGDNEEFFTSYDEVFESFDDMGLQENLLRGIYAYGFEKPSAIQQRGIVPFCKGLDVIQQAQSGTGKTATFCSGILQQLDYGLVECQSLVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 2535 - protein, 402 aa, Oryza sativa
  source: /note="subsp. japonica"
MATKRSVGTLGEADLRGKKVFVRADLNVPLDDAQKITDDTRIRASVPTVKFLLEKGAKVILASHLGRPKGVTPKYSLKPLVPRLSELLGVDVVMANDCIGEEVEKLAAALPEGGVLLLENVRFYKEEEKNDPEFAKKLAAVADLYVNDAFGTAHRAHASTEGVTKFLKPAVAGFLMQKELDYLVGAVANPKKPFAAIVGGSKVSTKIGVIESLLAKVDVLILGGGMIFTFYKAQGYAVGKSLVEEDKLELATSLIEKAKAKGVSLLLPTDVVVADKFAADAESKTVAASAIPDGWMGLDVGPDAIKTSSEALDTCNTIIWNGPMGVFEFEKFAAGTDAIAKKLADLTTTKGATTIIGGGDSVAAVEKAGLADKMSHISTGGGASLELLEGKTLPGVLALDEA

SEQ ID NO: 2536 - protein, 843 aa, Oryza sativa
  source: /note="subsp. japonica"
MVKFTVEELRRIMDKKNNIRNMSVIAHVDHGKSTLTDSLVAAAGIIAQEVAGDVRMTDTRADEAERGITIKSTGISLFYEMSDESLKLYKGERDGNEYLINLIDSPGHVDFSSEVTAALRITDGALVVVDCIEGVCVQTETVLRQALGERIRPVLTVNKMDRCFLELQVEGEEAYQTFSRVIENANVIMATYEDTLLGDVQVYPEKGTVAFSAGLHGWAFTLSSFAKMYASKFGVDESKMMERLWGENFFDPATKKWTNKSTGSATCKRGFVQFCYEPIKQIINTCMNDQKDKLWPMLQKLGVVMKADEKDLMGKALMKRVMQTWLPASNALLEMMIYHLPSPSKAQKYRVENLYEGPLDDVYATAIRNCDPEGPLMLYVSKMIPASDKGRFFAFGRVFSGRVATGMKVRIMGPNYVPGQKKDLYVKSVQRTVIWMGKKQESVEDVPCGNTVAMVGLDQFITKNATLTNEKEADACPIRAMKFSVSPVVRVAVQCKVASDLPKLVEGLKRLAKSDPMVLCTIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMTSDPLEVSSQANQLVLDIRKRKGLKEQMTPLSDFEDKL

SEQ ID NO: 2537 - protein, 156 aa, Oryza sativa
  source: /note="subsp. japonica"
MKIIFFFALLAIAACSASAQFDAVTQVYRQYQLQPHLMLQQQMLSPCGEFVRQQCSTVATPFFQSPVFQLRNCQVMQQQCCQQLRMIAQQSHCQAISSVQAIVQQLRLQQFASVYFDQSQAQAQAMLALNMPSICGIYPSYNTAPCSIPTVGGIWY

SEQ ID NO: 2538 - protein, 635 aa, Oryza sativa
  source: /note="subsp. japonica"
MASSLLSSPKPSSFSSANPTSTPRPRAQTLSPFRAAAPRFSHGLATAAAAANPSASRRCYHRAFARPVRASMAQPRRPEYVPNRIDDPNYVRIFDTTLRDGEQSPGATMTSAEKLVVARQLARLGVDIIEAGFPASSPDDLDAVRSIAIEVGNTPVGEDGHVPVICGLSRCNKRDIDAAWEAVRHARRPRIHTFIATSEIHMQHKLRKTPEQVVAIAKEMVAYARSLGCPDVEFSPEDAGRSNREFLYHILEEVIKAGATTLNIPDTVGYTLPYEFGKLIADIKANTPGIENAIISTHCQNDLGLATANTLAGAHAGARQLEVTINGIGERAGNASLEEVVMAIKCRRELLGGLYTGINTQHITMSSKMVQEHSGLHVQPHKAIVGANAFAHESGIHQDGMLKYKGTYEIISPDDIGLTRANEFGIVLGKLSGRHAVRSKLVELGYEITDKEFEDFFKRYKEVAEKKKRVTDEDIEALLSDEIFQPKVFWSLADVQATCGTLGLSTATVKLIGPDGDEKIACAVGTGPVDAAYKAVDDIIQIPTVLREYSMTSVTEGIDAIATTRVVVTGDVSDSKHALTGHSFNRAFSGSGAALDIVVSSVRAYLSALNKMSSFVGAIKASSEVSESQRVQTTE

SEQ ID NO: 2539 - protein, 469 aa, Oryza sativa
  source: /note="subsp. japonica"
MAVTADVKLEGLRAATDKLDQISENEKSGFISLVSRYLSGEAEQIEWSKIQTPTDEVVVPYDTLSAAPEDLNETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKTGKDGWYPPGHGDVFPSLNNSGKLDTLLAQGKEYVFVANSDNLGAIVDIKILNHLIHNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFEKAIGINVPRSRFLPVKATSDLLLVQSDLYTLVDGFVIRNPARTNPSNPSIELGPEFKKVANFLARFKSIPSIVELDTLKVSGDVWFGSGVTLKGKVTITAKSGKLEIPDGAVLENKDINGPEDL

SEQ ID NO: 2540 - protein, 157 aa, Oryza sativa
  source: /note="subsp. japonica"
MASNKVVISALLVVVVSVLAATTTMADHHQEQVVYTPGQLCQPGIGYPTYPLPRCRAFVKRQCVAPGTVDEQVRRGCCRQLAAIDSSWCRCDALNHMLRIIYRESGAADAGHPMAEVFRGCRRGDIERAAASLPAFCNVDIPNGVGGVCYWLPGTGY

SEQ ID NO: 2541 - protein, 401 aa, Oryza sativa
  source: /note="subsp. japonica"
MASKRSVGTLTESDLKGKKVFLRADLNVPLDDSQKITDDTRIRASVPTIKFLMGKGAKVILASHLGRPKGVTPKYSLKPLVPRLSELLGVDVVMANDCIGEEVQKLAATLPDGGVLLLENVRFYKEEEKNDPEFANKLASVADLYVNDAFGTAHRAHASTEGVTKYLRPSVAGFLMQKELDYLVGAVANPKKPFAAIVGGSKVSTKIGVIESLLAKVDILILGGGMIYTFYKAQGYAVGKSLVEEDKLELATSLIEKAKSKGVSLLLPTDIVVADKFAADAESKTVPASAIPDGWMGLDIGPDSIKTFSETLDTTKTVIWNGPMGVFEFEKFAAGTDAIAKKLADITAKGVTTIIGGGDSVAAVEKAGLADKMSHISTGGGASLELLEGKTLPGVLALNDA

SEQ ID NO: 2542 - protein, 337 aa, Oryza sativa
  source: /note="subsp. japonica"
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKAAAHLKGGAKKVVISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIFDAKAGIALNDNFVKLVAWYDNEWGYSNRVIDLIRHMAKTQ

SEQ ID NO: 2543 - protein, 500 aa, Oryza sativa
  source: /note="subsp. japonica"
MAMMAMGAASWAPIPAPARAAAAFYPGRDLAAARRRRGAAARRPFVFTPRAVSDSRSSQTCLDPDASTSVLGIILGGGAGTRLYPLTKKRAKPAVPLGANYRLIDIPVSNCLNSNVSKIYVLTQFNSASLNRHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 2544 - protein, 885 aa, Oryza sativa; identical to SEQ ID NO: 841
  source: /note="subsp. japonica"

SEQ ID NO: 2545 - protein, 160 aa, Oryza sativa
  source: /note="subsp. japonica"
MASNKVVFSVLLLAVVSVLAATATMAEYHHQDQVVYTPAPLCQPGMGYPMYPLPRCRALVKRQCVGRGTAAAAEQVRRDCCRQLAAVDDSWCRCEAISHMLGGIYRELGAPDVGHPMSEVFRGCRRGDLERAAASLPAFCNVDIPNGGGGVCYWLARSGY

SEQ ID NO: 2546 - protein, 160 aa, Oryza sativa
  source: /note="subsp. japonica"
MAFIKVVFSVLLPVVVSMLVATTTMADHRGQVVYTPGQLCAAGRGYPMYPLPRCRALAKRQCAGGAVDEQVRQDCCRQLAAIDDSFCRCPALSHMLVGMYKELGAPAKGQPMDEVFPGCRRGDMKRVAASLPAFCNVDIPIGIGGVCYWLSYPMNPATGH

SEQ ID NO: 2547 - protein, 156 aa, Oryza sativa
  source: /note="subsp. japonica"
MKIIFVFALLAIVACNASARFDALSQSYRQYQLQSHLLLQQQVLSPCSEFVRQQHSIVATPFWQPATFQLINNQVMQQQCCQQLRLVAQQSHYQAISSVQAIVQQLQLQQVGVVYFDQTQAQAQALLALNLPSICGIYPNYYIAPRSIPTVGGVWY

SEQ ID NO: 2548 - protein, 327 aa, Oryza sativa
  source: /note="subsp. japonica"
MSAAPIPREWVGLQQFPAATQTKLHELLGKLKEENVSTLTILVMGKGGVGKSSTVNSIVGERVATVSAFQSEGLRPMMCSRTRAGFTLNIIDTPGLIEGGYINEQAVEIIKRFLLGKTIDVLLYVDRLDAYRMDTLDDQVIRAVTNSFGKAIWRRTLVVLTHAQLSPPDGLDYNDFFTKRSESLLRYIRAGAGVSKRELGDFPLPIALVENSGRCKTNENGEKVLPDGTPWIPNLMKEITTVVSNGSKSIHVDQKLIDGPNPNNRWKMFIPLILMVEYFLVVKGIRRAIHADISNGKLDDWEQRYRDLVGSKDPVDQKGSSSGNRKA

SEQ ID NO: 2549 - protein, 377 aa, Oryza sativa
  source: /note="subsp. japonica"
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDMKEKLSYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 2550 - protein, 159 aa, Oryza sativa
  source: /note="subsp. japonica"
MALASDKFVLSAIVLAVLTVAAAAAGYGGYGDVGEYCRVGKAVSRNPVPSCRNYIARWCAVAGGRLDSGKQPPRQLLEPCCRELAAVPMQCRCDALSVLVRGVVTEEGDRVAGMISQHAAPGCDAATIAGMASALTDYGRCNLQHTGFFGCPMFGGGMD

SEQ ID NO: 2551 - protein, 725 aa, Oryza sativa
  source: /note="subsp. japonica"
VEAVVMPERYALGGACRVLAGMPAPLGATALDGGVNFAVYSAGASAASLCLFTPDDLEADEVTEEVPLDPLFNRTGNVWHVFIEGELHNMLYGYRFDGMFAPHCGQYFDVSNVVVDPYAKAVISRGEYGVPGPGGDCWPQMAGMIPLPYSTFDWQGDLPLRYPQKDLVIYEMHLRGFTKHSSSNVEHPGTYIGAISKLDYLKELGVNCVELMPCHEFNELEYFSCSSKMNFWGYSTINFFSPMIRYSSGGIRNCGRDAINEFKTFVREAHKRGIEVIMDVVFNHTAEGNEKGPILSFRGIDNSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKYRDIVRQFIKGTDGFAGGFAECLCGSPHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSTKDETKGEIYVAFNASHLPAVVGLPERPGYRWEPLVDTGKPAPYDFLTDDLPDRAHAVHLFSHFLNSNLYPMLSYSSIILELQPDD

SEQ ID NO: 2552 - protein, 153 aa, Oryza sativa
  source: /note="subsp. japonica"
MKIIFVFALLAIAANSASAQFDVLGQSYRQYQLQSPLLLQQHVLSPYNEFVRQQYGIAASPLLQSAAFQLRNNQVWQQLRLVAQQSHYQDINIVQAIAQQLQLQQFDDLYFGRNLAQAQAQALLALNLPSRYGIYPRYYSAPSSITTLGGVLY

SEQ ID NO: 2553 - protein, 149 aa, Oryza sativa
  source: /note="subsp. japonica"
MKIFVILSLLALAASSASAQFDACTYGQCQQQPFMQPIMNPCNEFVRQQCSPMSLPWEQSRRLQLSSCQVMRQQCCQQMRLMAQQYHCQAICTMVQSIMQQVQFDAGFVGEPQAQAQAQVALNLPSMCGVYPRYCSTPCKVATGHCGSW

SEQ ID NO: 2554 - protein, 156 aa, Oryza sativa
  source: /note="subsp. japonica"
MKIIFVFALLAIVACNASARFDPLSQSYRQYQLQSHLLLQQQVLSPCSEFVRQQYSIVATPFWQPATFQLINNQVMQQQCCQQLRLVAQQSHYQAISIVQAIVQQLQLQQFSGVYFDQTQAQAQTLLTFNLPSICGIYPNYYSAPRSIATVGGVWY

SEQ ID NO: 2555 - protein, 416 aa, Oryza sativa
  source: /note="subsp. japonica"
MALVLHCGSGNKNAFKALIAAEYTGVKVELTKNFEMGVSNKTPEFLKMNPLGKIPVLETPEGAVFESNAIARYVARLKDNSSLCGSSLIDYSHIEQWMDFSATEVDANIGRWLYPRLGFGPYVPVLEEFAITSLKRSLGALNTHLASNTYLVGHSVTLADIVMTCNLYYGFVRILIKSFTSEFPHVERYFWTMVNQPNFKKVIGDFKQAESVPPVQKKAAPPKESKAKEAKKEAPKEAPKPKVEASEEEEAPKPKPKNPLDLLPPSKMILDEWKRLYSNTKTNFREIAIKGFWDMYDPEGYSLWFCDYKYNDENTVSFVTMNKVGGFLQRMDLCRKYAFGKMLVIGSTPPFKVKGLWLFRGQDIPKFVMDEVYDMELYEWTKVDLSDEAQKERVNAMIEDQEPFEGEDLLDAKCFK

SEQ ID NO: 2556 - protein, 146 aa, Oryza sativa; identical to SEQ ID NO: 563
  source: /note="subsp. japonica"

SEQ ID NO: 2557 - protein, 158 aa, Oryza sativa [sequence omitted]

SEQ ID NO: 2558 - protein, 151 aa, Oryza sativa
  source: /note="subsp. japonica"
MKIIFVFALLAIAACSATAQFDVLGQNIRQYQVQSPLLLQQQVLSLYNEFVRQQYSIAASPFLQSAVFQLRNNQVLQQLRLVAQQSHYQDINVVQAIAQQLHLQQFGDLYIDRNLAQAQALLAFNLPSTYGIYPRYYSAPGSITTLGGVLY

SEQ ID NO: 2559 - protein, 153 aa, Oryza sativa
  source: /note="subsp. japonica"
MKIIFAFALLTIAACSASAQFDVLGQSYRQYQLQSPLLLQQQVLSPYNEFVRQQYGITASPLLQSVAFQLRNNQVWQQLWLVAQQSHYEDINIFQVIAQQLQLQQFDDLYFDRNLAQAPAQALLALNLPSRYGIYPRYYSAPSSITTLGGLLY

SEQ ID NO: 2560 - protein, 376 aa, Oryza sativa
  source: /note="subsp. japonica"
MADEDIQPIVCDNGTGMVKAGFAGDDAPRAVFPSIVGRPRHTGVMVGMGQKDAYVGDEAQAKRGILTLKYPIEHGIVNNWDDMEKIWHHTFYNELRVAPEDHPVLLTEAPLNPKANREKMTQIMFETFNCPAMYVAIQAVLSLYASGRTTGIVLDSGDGVSHTVPIYEGYTLPHAILRLDLAGRDLTDHLMKILTERGYSLTTSAEREIVRDIKEKLAYVALDYEQELETSRSSSSVEKSYEMPDGQVITIGSERFRCPEVLFQPSLVGMESPGIHEATYNSIMKCDVDIRKDLYGNVVLSGGSTMFPGIADRMSKEITSLAPSSMKVKVIAPPERKYSVWIGGSILASLSTFQQMWISKGEYDESGPGIVHMKCF

SEQ ID NO: 2561 - protein, 522 aa, Oryza sativa
  source: /note="subsp. japonica"
MGTRRVGLLLLLLLAAVLLQPLLAAAAAEGVVRIALKKRQVDETGRVGGHLAGEDAQRLLARRHGFLTNDAARAASRKARAEAEGDIVALKNYLNAQYYGEIAIGTPPQMFTVIFDTGSSNLWVPSSKCHLSIACYFHSRYKAGQSSTYKKNGKPASIHYGTGAISGYFSQDSVKVGDVAVKNQDFIEATREPSITFMVAKFDGILGLGFKEISVGNAVPIWYNMVRQGLVVDPVFSFWFNRHADEGQGGEIVFGGIDPNHYKGNHTYVPVTRKGYWQFNMGDVLIGGNSTGFCAAGCAAIADSGTSLLTGPTAIITQINEKIGATGVVSQECKAVVSQYGQQILDQLRAETKPAKVCSSVGLCTFDGTHGVSAGIRSVVDDEVGKSSGPFSSAMCNACETAVVWMHTQLAQNQTQDLVLQYIDQLCDRLPSPMGESSVDCSSLASMPDIAFTIGGNKFVLKPEQYILKVGEGTATQCISGFTAMDIPPPRGPLWILGDVFMGAYHTVFDYGNLKVGFAEAA

SEQ ID NO: 2562 - protein, 332 aa, Oryza sativa
  source: /note="subsp. japonica"
MAKEPMRVLVTGAAGQIGYALVPMIARGVMLGADQPVILHMLDIPPATESLNGLKMELVDAAFPLLKGIVATTDVVEACTGVNVAVMVGGFPRKEGMERKDVMSKNVSIYKSQASALEAHAAPNCKVLVVANPANTNALILKEFAPSIPEKNITCLTRLDHNRALGQISEKLNVQVTDVKNAIIWGNHSSTQYPDVNHATVKTPSGEKPVRELVADDEWLNTEFISTVQQRGAAIIKARKQSSALSAASSACDHIRDWVLGTPEGTFVSMGVYSDGSYGVPAGLIYSFPVTCSGGEWTIVQGLPIDEFSRKKMDATAQELSEEKTLAYSCLN

SEQ ID NO: 2563 - protein, 483 aa, Oryza sativa
  source: /note="subsp. japonica"
MELPRMASRRLPLPLVAQLVVLLGLACGLRSSSAAAAAASGLAGERVTYLPGQPPVDFDMYSGYVTVDKRAGRSLFYWLQEAPAAAQPAPLVLWLNGGPGCSSVAYGASEELGAFRIRPDGATLFLNDYRWNKVANILFLDSPAGVGFSYTNTTSDLYDSGDKRTAHDSYKFLVKWFEKFPQYKYRDFYIAGESYAGHYVPQLSQLVYRNNKGVKEPLINFKGFMVGNAVTDDYHDYIGTFEYWWNHGIISDGTYRLLNASCVHDSGEHPAPACLAALNASTVEQGDIDMYSLYTPTCNETSTSSAAARQRRLKQGHYPWMTGSYDPCTERYSTEYYNRPEVQRALHANVTGINYTWATCSDILNDNWRDSPRSVLPIYHELIAAGLRIWVFSGDTDAVVPLTATRYSIDALGLPTTVSWYPWYDAMKVGGWSQVYKGLSLVTVRGAGHEVPLHRPRQALILFKHFLQGKPMPDAPTKVQNEA

SEQ ID NO: 2564 - protein, 348 aa, Oryza sativa
  source: /note="subsp. japonica"
MFGFGHHGHHGQDQPPQHHGGGGGGAHQPTFKIFCRADEGYCVAVREGNVVLAPTNPRDEHQHWYKDMRFSAKIKDEEGNPAFALVNKATGLAIKHSLGQGHPVKLAPFNPEYPDESVLWTESGDVGKSFRCIRMLNNIRLNFDAFHGDKDHGGVHDGTTIVLWEWAKGDNQCWKILPWGDEAYAGGSANAPRGGNEPTVRIFCKADEGFSVTVRGGSVCLAPTNPRDEYQHWIKDMRHSNSIKDEEGYPAFALVNRVTGEAIKHSQGEGHPVKLVPYNPGYQDESVLWTESRDVGHGFRCIRMVNNIYLNFDALHGDKDHGGVRDGTTVALWKWCEGDNQRWKIVPW

SEQ ID NO: 2565 - protein, 418 aa, Oryza sativa
  source: /note="subsp. japonica"
MALVLHAGSGNKNAFKALIAAEYSGVKVELVKNFQMGVSNKTPEFLKMNPIGKIPVLETPDGPVFESNAIARYVTRSKADNPLYGSSLIEYAHIEQWNDFSATEVDANIGKWLYPRLGIAPYVAVSEEAAIAALKRSLGALNTHLASNTYLVGHSVTLADIVMTCNLYMGFARIMTKSFTSEFPHVERYFWTMVNQPNFKKVLGDVKQAESVPPVQKKAPPPKEQKPKEAKKEAPKEAPKPKAVEKPEEEEEAPKPKPKNPLDLLPPSKMILDEWKRLYSNTKTNFREVAIKGFWDMYDPEGYSLWFCDYKYNDENTVSFVTMNKVGGFLQRMDLCRKYAFGKMLVIGSEPPFKVKGLWLFRGPEIPKFVMDEVYDMELYEWTKVDISDEAQKERVSAMIEDLEPFEGESLLDAKCFK

SEQ ID NO: 2566 - protein, 582 aa, Oryza sativa
  source: /note="subsp. japonica"
MVLFSVTKKATTPFDGQKPGTSGLRKKVTVFQQPHYLQNFVQSTFNALPADKVKGATIVVSGDGRYFSKDAVQIITKMAAANGVRRVWVGQNSLMSTPAVSAVIRERVGADGSKATGAFILTASHNPGGPTEDFGIKYNMENGGPAPESVTDKIFSNTTTITEYLIAEDLPDVDISVVGVTTFSGPEGPFDVDVFDSTIDYIKLMKTIFDFESIKKLLASPKFTFCYDALHGVAGTYATRIFVEELGAAESSLLNCVPKEDFGGGHPDPNLTYAKELVDRMGLGKSSNAEPPEFGAAADGDADRNMILGKRFFVTPSDSVAIIAANAVQSIPYFSSGLKGVARSMPTSAALDVVAKNLNLKFFEVPTGWKFFGNLMDAGMCSICGEESFGTGSDHIREKDGIWAVLAWLSILAFKNKDNLGGDKLVTVEDIVRQHWGTYGRHYYTRYDYENVDAGAAKELMANLVSMQSSLSDVNKLIKEIRSDVSDVVAADEFEYKDPVDGSVSKHQGVRYLFGDGSRLVFRLSGTGSVGATIRVYIEQYEKDSSKTGRDSQDALAPLVDVALKLSKMQEYTGRSAPTVIT

SEQ ID NO: 2567 - protein, 163 aa, Oryza sativa
  source: /note="subsp. japonica"
MASNKVVFSVLLLVVLSVLAAAMATMADHHQVYSPGEQCRPGISYPTYSLPQCRTLVRRQCVGRGAASAADEQVWQDCCRQLAAVDDGWCRCGALDHMLSGIYRELGATEAGHPMAEVFPGCRRGDLERAAASLPAFCNVDIPNGPGGVCYWLGYPRTPRTGH

SEQ ID NO: 2568 - protein, 295 aa, Oryza sativa
  source: /note="subsp. japonica"
MDNEWARNRGFYGGTGGGVVGGLLPQSDVDLLEFPLNLEYLEAEFFCWSALGYGLDGIDASLTGGGPAPVGAQTAALTPFVRDIATQFCYQEVGHLREIKQNVKGFPRPLLDISAANFGKIVETAMNTTLDPPFNPYENSLNFLLASYIIPYVGLTGYVGANPRLLTPQARKLVAGLLGVESAQDAVIRALLYEHGLSRVASYGVGVAELTAHISELRNVLGRKGVKDEGLVVAPGQGPEGQTVGNIIAGDRFSLAYDRTPEEILGVVYGSGDPAKAGGFFPQGADGRIARAFIA

SEQ ID NO: 2569 - protein, 334 aa, Oryza sativa
  source: /note="subsp. japonica"
MAGAQESLVLAGVMHGHNDVVTAIATPIDNSPFIVSSSRDKSLLVWDLTNPVQNVGEGAGASEYGVPFRRLTGHSHFVQDVVLSSDGQFALSGSWDGELRLWDLSTGVTTRRFVGHDKDVLSVAFSVDNRQIVSASRDRTIKLWNTLGECKYTIGGDLGGGEGHNGWVSCVRFSPNTFQPTIVSGSWDRTVKVWNLTNCKLRCNLEGHGGYVNAVAVSPDGSLCASGGKDGVTLLWDLAEGKRLYSLDAGSIIHSLCFSPNRYWLCAATQDSIKIWDLESKHIVQDLKPEIPVSKNQMLYCTSLNWSADGSTLYAGYTDGTIRIYKISGFSYAG

SEQ ID NO: 2570 - protein, 515 aa, Oryza sativa
  source: /note="subsp. japonica"
ASSSCLPPLYPPTLSPSQIRSRKSSPPPLPWRSPWRRPRRGGSFKVKDLSQADFGRLEIELAEVEMPGLMACRAEFGPSQPFKGARISGSLHMTIQTAVLIETLTALGAEVRWCSCNIFSTQDHAAAAIARDSAAVFAWKGETLEEYWWCTERCLDWGVGGGPDLIVDDGGDATLLIHEGVKAEEEFEKSGKVPDPESTDNAEFKIVLTIIRDGLKSDPSKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSTGKYEKKVYVLPKHLDEKVAALHLGKLGARLTKLSKSQADYISVPVEGPYKPAHYRY

SEQ ID NO: 2571 - protein, 601 aa, Oryza sativa
  source: /note="subsp. japonica"
MAVAAATVRWLVLLLAVSAAATASREKWWHGAGGEASGGGHLVQKEWRRVVAASDAGLVTAVDVADAAGTAYRLHFITMSPGTLFLPVQLHADMVFYVHSGRGKVTYIEEGDSESSSLQVERGDVYNFDQGTILYIQSNACGTRERLQIYAIFTSDSINADDPRHPTSEVYSFVSDLLKGFEVEVLRPGFGVPREVVESIKSTKTPPAIIPYNPEEEDEDDSSNWTEEITDALWGVRDPHFLNKKKKDKQKDKHKGKDKKSKSKAFNFYSGKPDVENCYGWSRSMTNRDLETLRGSNIGMFMVNLTTGAMMGPHWNPRATEIAVVTQGAGMVQIVCPSIPSGESKKHHHDEEGGRGDHGHGGGGVRCKNSLFRVKEGDVLVVPRFHPMAQISFNNDSFVFVGFSTDMGHNHPQFLAGRHSVLQVIGKEILARSLGQDNSTNVGRLLSSQRESTIMACTSCAEELERKAEEEEEGGGGKGEKEREEEERRQREKEEEERRRQEEERKRREEEEKERREREEEERRQREKEEKKRREEEEQRREEEEEERRREEEEEEQEDGRGDEPKPRREEEEGDWGERQIRLPRSLKKRFIGIKGRLSSG

SEQ ID NO: 2572 - protein, 649 aa, Oryza sativa
  source: /note="subsp. japonica"
MAGKGEGPAIGIDLGTTYSCVGVWQHDRVEIIANDQGNRTTPSYVGFTDSERLIGDAAKNQVAMNPINTVFDAKRLIGRRFSDASVQSDIKLWPFKVIAGPGDKPMIVVQYKGEEKQFAAEEISSMVLIKMREIAEAYLGTTIKNAVVTVPAYFNDSQRQATKDAGVIAGLNVMRIINEPTAAAIAYGLDKKATSVGEKNVLIFDLGGGTFDVSLLTIEEGIFEVKATAGDTHLGGEDFDNRMVNHFVQEFKRKNKKDITGNPRALRRLRTACERAKRTLSSTAQTTIEIDSLYEGIDFYSTITRARFEELNMDLFRKCMEPVEKCLRDAKMDKSSVHDVVLVGGSTRIPRVQQLLQDFFNGKELCKNINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQEAEKYKSEDEEHKKKVESKNALENYAYNMRNTIKDEKIASKLPAADKKKIEDAIDQAIQWLDGNQLAEADEFDDKMKELEGICNPIIAKMYQGAGADMAGGMDEDDAPPAGGSGAGPKIEEVD

SEQ ID NO: 2573 - protein, 699 aa, Oryza sativa
  source: /note="subsp. japonica"
MASETETFAFQAEINQLLSLIINTFYSNKEIFLRELISNSSDALDKIRFESLTDKSKLDAQPELFIHIVPDKASNTLSIIDSGVGMTKSDLVNNLGTIARSGTKEFMEALAAGADVSMIGQFGVGFYSAYLVAERVVVTTKHNDDEQYVWESQAGGSFTVTRDTSGEQLGRGTKITLYLKDDQLEYLEERRLKDLVKKHSEFISYPISLWTEKTTEKEISDDEDEEEKKDAEEGKVEDVDEEKEEKEKKKKKIKEVSHEWNVMNKQKPIWLRKPEEITKEEYAAFYKSLTNDWEEHLAVKHFSVEGQLEFKAILFVPKRAPFDLFDTRKKQNNIKLYVRRVFIMDNCEELIPEWLSFVKGIVDSEDLPLNISREMLQQNKILKVIRKNLVKKCVELFFEIAENKEDYNKFYEAFSKNLKLGIHEDSTNRTKIAELLRYHSTKSGDELTSLKDYVTRMKEGQSEIYYITGESKKAVENSPFLEKLKKKGYEVLYMVDAIDEYAVGQLKEFEGKKLVSATKEGLKLDESEDEKKRQEELKEKFEGLCKVIKEVLGDKVEKVVVSDRVVDSPCCLVTGEYGWTANMERIMKAQALRDSSMAGYMSSKKTMEINPENAIMDELRKRADADKNDKSVKDLVMLLFETALLTSGFSLEDPNTFGTRIHRMLKLGLSIDEDESAEADADMPPLEDDAGESKMEEVD

SEQ ID NO: 2574 - protein, 151 aa, Oryza sativa
  source: /note="subsp. japonica"
MKIIFVFALLAIAACSATAQFDVLGQNIRQYQVQSPLLLQQQVLSPYNEFVRQQYSIAASTFLQSAAFQLRNNQVLQQLRLVAQQSHYQDINVVQAIAHQLHLQQFGNLYIDRNLAQAQALLAFNLPSTYGIYPWSYSAPDSITTLGGVLY

SEQ ID NO: 2575 - protein, 253 aa, Oryza sativa
  source: /note="subsp. japonica"
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFIDIINSATVKSA

SEQ ID NO: 2576 - protein, 261 aa, Oryza sativa
  source: /note="subsp. japonica"
MGRVIRAQRKGAGSVFKSHTHHRKGPARFRSLDFGERNGYLKGVVTDIIHDPGRGAPLAKVTFRHPFRYKHQKELFVAAEGMYTGQFVYCGRRATLSIGNVLPIRSVPEGAVVCNVEHHVGDRGVFARASGDYAIVISHNPDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKAT

SEQ ID NO: 2577 - protein, 291 aa, Oryza sativa [sequence omitted]

SEQ ID NO: 2578 - protein, 418 aa, Oryza sativa
  source: /note="subsp. japonica"
MALVLHTFDGNKNAFKALIAAEYSGVKVELAKNFQMGVSNKTPEYLKMNPIGKVPILETPDGPVFESNAIARYVTRSKSDNPLYGSSLIEYAHIEQWIDFSATEVDANTGKWLFPRLGFAPYVAVSEEAAIAALKRSLGALNTHLASNTYLVGHSVTLADIVMTCNLYMGFARIMTKNFTSEFPHVERYFWTMVNQPNFKKVMGDVKQADSVPQVQKKAAAPKEQKPKEAKKEAPKEAPKPKAAEKPEEEEEAPKPKPKNPLDLLPPSKMILDEWKRLYSNTKTNFREVAIKGFWDMYDPEGYSLWFCDYKYNDENTVSFVTMNKVGGFLQRMDLCRKYAFGKMLVIGSEPPFKVKGLWLFRGPEIPKFVMDEVYDMELYEWTKVDISDEAQKERVSAMIEDLEPFEGEALLDAKCFK

SEQ ID NO: 2579 - protein, 446 aa, Oryza sativa
  source: /note="subsp. japonica"
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 2580 - protein, 641 aa, Oryza sativa
  source: /note="subsp. japonica"
MATAAGMGIGAACLVAPQVRPGRRLRLQRVRRRCVAELSRDGGSAQRPLAPAPLVKQPVLPTFLVPTSTPPAPTQSPAPAPTPPPLPDSGVGEIEPDLEGLTEDSIDKTIFVASEQESEIMDVKEQAQAKVTRSVVFVTGEASPYAKSGGLGDVCGSLPIALALRGHRVMVVMPRYMNGALNKNFANAFYTEKHIKIPCFGGEHEVTFFHEYRDSVDWVFVDHPSYHRPGNLYGDNFGAFGDNQFRYTLLCYAACEAPLILELGGYIYGQKCMFVVNDWHASLVPVLLAAKYRPYGVYRDARSVLVIHNLAHQGVEPASTYPDLGLPPEWYGALEWVFPEWARRHALDKGEAVNFLKGAVVTADRIVTVSQGYSWEVTTAEGGQGLNELLSSRKSVLNGIVNGIDINDWNPSTDKFLPYHYSVDDLSGKAKCKAELQKELGLPIRPDVPLIGFIGRLDYQKGIDLIKLAIPDLMRDNIQFVMLGSGDPGFEGWMRSTESGYRDKFRGWVGFSVPVSHRITAGCDILLMPSRFEPCGLNQLYAMQYGTVPVVHGTGGLRDTVENFNPFAEKGEQGTGWAFSPLTIEKMLWALRMAISTYREHKSSWEGLMKRGMSSDFTWDHAASQYEQIFEWAFMDQPYVM

SEQ ID NO: 2581 - protein, 810 aa, Oryza sativa
  source: /note="subsp. japonica"
MSSAVVASSTTFLVALASSASRGGPRRGRVVGVAAPPALLYDGRAGRLALRAPPPPRPRPRRRDAGVVRRADDGENEAAVERAGEDDDEEEEFSSGAWQPPRSRRGGVGKVLKRRGTVPPVGRYGSGGDAARVRGAAAPAPAPTQDAASSKNGALLSGRDDDTPASRNGSVVTGADKPAAATPPVTITKLPAPDSPVILPSVDKPQPEFVIPDATAPAPPPPGSNPRSSAPLPKPDNSEFAEDKSAKVVESAPKPKATRSSPIPAVEEETWDFKKYFDLNEPDAAEDGDDDDDWADSDASDSEIDQDDDSGPLAGENVMNVIVVAAECSPWCKTGGLGDVAGALPKALARRGHRVMVVVPRYGDYAEAQDVGIRKYYKAAGQDLEVKYFHAFIDGVDFVFIDAPLFRHRQDDIYGGNRQEIMKRMILFCKAAVEVPWHVPCGGVPYGDGNLVFLANDWHTALLPVYLKAYYRDNGMMQYTRSVLVIHNIAYQGRGPVDEFPYMELPEHYLDHFKLYDPVGGEHANIFGAGLKMADRVVTVSPGYLWELKTTEGGWGLHDIIRENDWKMNGIVNGIDYREWNPEVDVHLQSDGYANYTVASLDSSKPRCKAALQRELGLEVRDDVPLIGFIGRLDGQKGVDIIGDAMPWIAGQDVQLVLLGSGRRDLEVMLQRFEAQHNSKVRGWVGFSVKMAHRITAGADVLVMPSRFEPCGLNQLYAMAYGTVPVVHAVGGLRDTMSAFDPFEDTGLGWTFDRAEPHKLIEALGHCLETYRKYKESWRGLQVRGMSQDLSWDHAAELYEEVLVKAKYQW

SEQ ID NO: 2582 - protein, 149 aa, Oryza sativa
  source: /note="subsp. japonica"
MEQSFIMIKPDGVQRGLIGDIISRFEKKGFYLRGMKFMNVERSFAQQHYADLSDKPFFPGLVEYIISGPVVAMVWEGKDVVATGRRIIGATRPWEAAPGTIRADYAVEVGRNVIHGSDSVDNGKKEIALWFPEGLAEWRSNLHPWIYES

SEQ ID NO: 2583 - protein, 425 aa, Oryza sativa
  source: /note="subsp. japonica"
FARPRHHKTLAAAAAAAAAAMATQTRPLVSVKALEGDMATDNSSSLALAEVFRAPLRPDVVRFVHRLLSCNKRQPYAVSRRAGHQTSAESWGTGRAVSRIPRVPGGGTHRAGQGAFGNMCRGGRMFAPTKTWRKWHRRVNVHLRRVAVASALAATSVPSLVLARGHRIETVPELPLVISDSAESIEKTSQAIKILKQVGAYADAEKAKDSVGIRPGKGKMRNRRYINRKGPLIVYGTEGSKIVKAFRNLPGVDVANVERLNLLDLAPGGHLGRFVIWTESAFKKLEEVYGTFEAPSLKKKGFILPRPKMANADLGRIINSDEVQSVVKPLNKEVKRREKRKNPLKNVAAVLKLNPYFGTARKMATLAEAARIKARKEKLDSKRTKLSPEEAAKVKAAGKAWYKTMISDSDYAEFDNFSKWLGVTQ

SEQ ID NO: 2584 - protein, 151 aa, Oryza sativa
  source: /note="subsp. japonica"
MALEQTFIMIKPDGVQRGLIGEVIGRFEKKGFYLKAMKLINVEKSFAEKHYADLSSKPFFGGLVEYIVSGPVVAMVWEGKQVVSTGRKLVGATNPLAAEPGTIRGDFAVDIGRNVIHGSDSVENARKEIALWFPEGIAEWRSNQHPWIYEV

SEQ ID NO: 2585 - protein, 256 aa, Oryza sativa
  source: /note="subsp. japonica"
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDACEGQ

SEQ ID NO: 2586 - protein, 262 aa, Oryza sativa
  source: /note="subsp. japonica"
MSAQAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDTAEEIREAPKRDSSEGQ

SEQ ID NO: 2587 - protein, 359 aa, Oryza sativa
  source: /note="subsp. japonica"
MASVDLTPRQARKAYGGDGGTYYEWSPADLPMLELANIGGAKLSLNAGGLALPSFSDSGKVAYVLQGKGTCGIVLPEASKEKVIAVKEGDSLALPFGVVTWWHNLPESPIELVILFLGDTSKAHKAGQFTNMQLTGATGIFTGFSTEFVGRAWDLAESDAVKLVSSQPASGIVKIKSGQKLPEPSAADREGMALNCLEAPLDVDIKNGGRVVVLNTANLPMVKEVGLGADLVRIDGHSMCSPGFSCDSAYQVTYFIRGSGRVQVVGADGKRVLDTHVEGGNLFIVPRFCVVSKIADASGLQWFSIITTPNPIFSHLAGKTSVWKAISPEVLEASFNATPEMEKLFRSKRIDSEIFFAPN

SEQ ID NO: 2588 - protein, 459 aa, Oryza sativa
  source: /note="subsp. japonica"
KKNNETILVFDLGGGTFDVSVLEVGDGVFEVLSTSGDTHLGGDDFDKRVVDWLAGNFKNDEGIDLLKDKQALQRLTEAAEKAKMELSSLTQTNISLPFITATADGPKHIETTLTRAKFEELCSDLLDRLRTPVDNALRDAKLSFKDIDEVILVGGSTRIPAVQDLVKKMTGKDPNVTVNPDEVVALGAAVQAGVLSGDVSDIVLLDVTPLSLGLETLGGVMTKIIPRNTTLPTSKSEVFSTAADGQTSVEINVLQGEREFVRDNKSLGSFRLDGIPPAPRGVPQIEVKFDIDANGILSVSAVDKGTGKKQDITITGASTLPKDEVEKMVEEAEKFAKEDKEKRDAIDTKNQAESVIYQTEKQLKELGDKVPGDVKGKVEAKLTELKDAVAGGSTQTMKDALAALNQEVMQLGQALYSQQGAPGAGPTPGADAAAGSAGPSEKPGGEEGDVIDADFTDSQ

SEQ ID NO: 2589 - protein, 463 aa, Oryza sativa
  source: /note="subsp. japonica"
MHTRSRRLGFPPLNPSHLLLTPHLPPLSSDRARMAMSRAAAAAAGTPVARRRLMGAVAARSMASWFGHVEPAAKDPILGVTEAFLADPSPDKVNVGVGAYRDDSGKPVVLECVREAERRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPLYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTK

SEQ ID NO: 2590 - protein, 481 aa, Oryza sativa
  source: /note="subsp. japonica"
MAHALGCGAATAPAGVGLLHHHEKAGALFSAAGSIVRVQQLSGKGSKSQAIRCAMPSASEHGGISTATASSSDQKKGGLRGKLNKVVLAYSGGLDTSVIVPWLRENYGCEVVCFTADVGQGDIELEGLEKKAKASGASQLVVKDLKEEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPIPVTKKSIYSRDRNLWHLSHEGDILEDPANEPKEDMYMMSVAPENAPSKPEYLEIGIIAGVPVSINGKDLSPASLLAKLNEIGGKHGIGRIDMVENRLVGMKSRGVYETPGGTIMAAAVRELESLTLDRETMQWKDMLALKYAELVYAGRWFDPLRQSIDAFMENITATTTGSVTLKLYKGSVNVASRKSPYSLYREDISSFENGEIYNQADAEGFIRLYGLPTRVRAMLEKGI

SEQ ID NO: 2591 - protein, 509 aa, Oryza sativa; identical to SEQ ID NO: 747
  source: /note="subsp. japonica"

SEQ ID NO: 2592 - protein, 552 aa, Oryza sativa
  source: /note="subsp. japonica"
MATRRALSSLVRAASRLRGASPAPRPRGPLHRPSPSGYLFNRAAAYATAAAAKEAAPPAPATGKATGGGKITDEFTGAGAVGQVCQVIGAVVDVRFDEGLPPILTALEVLDHNIRLVLEVAQHLGENMVRTIAMDGTEGLVRGQRVLNTGSPITVPVGRATLGRIMNVIGEPIDEKGDITTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVNSFQGVLDGKYDDLPEQSFYMVGGIEEVIAKAEKIAKESAS

SEQ ID NO: 2593 - protein, 707 aa, Oryza sativa
  source: /note="subsp. japonica"
MDVSVPPTNYPKSLSSIIKCHRRRAAINNCHSVVSHPPLSHSNHHHRSLRVRSSAAVAPPLPPPLVVPMTTPKPSPTIRRLDVASPVPADIDIANAVSPLPIADIAAELGLRPEHFDLYGKYKAKVLLSVLDELKGQQDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHEASQSDKALFNRLCPPNKEGKRRFADVMLRRLIKLGISKTDPNELTPDEVRRFARLDIDPESITWRRVMDVNDRFLRKITIGQGPDEKGMVRETGFDIAVASEIMAVLALTTSLADMRERLGRMVIGNSKAGEPITADDLGVGGALTVLMKDAIHPTLMQTLEGTPVLVHAGPFANIAHGNSSIVADKIALKLVGKGGYVVTEAGFGSDIGTEKFMDIKCRYSGLMPQCAIIVATIRALKMHGGGPDVVAGKPLDHAYVSENVALVEAGCVNLAKHIANTKSYGVNVVVAINKFASDTEAEMDVVRNASLAAGAFDAVVCTHHAHGGKGAVDLGLAVQRACESQADPLKFLYPLESGIKEKIESIAKFYGASGVEYSEQAEKQIEMYTKQGFSNLPICMAKTQYSFSHVPSMKGAPSGFVLPIRDVRASIGAGFIYPLVGTMSTMPGLPTRPCFYEIDVDTATGKVMGLS

SEQ ID NO: 2594 - protein, 766 aa, Oryza sativa
  source: /note="subsp. japonica"
MASHIVGYPRMGPKRELKFALESFWDGKSSAEDLEKVATDLRASIWKQMADAGIKYIPSNTFSYYDQVLDTTAMLGAVPERYSWTGGEIGFSTYFSMARGNATVPAMEMTKWFDTNYHFIVPELGPNTKFSYSSHKAVNEYKEAKALGVDTVPVLVGPVSYLLLSKPAKGVEKSFALLSLLSSILPVYKEVIAELKAAGATWIQFDEPTLVLDLDSHQLAAFSAAYTELESALSGLNVLIETYFADIPAESYKTLTSLNSVTAYGFDLIRGSKTLDLVKSAGFPSGKYLFAGVVDGRNIWADDLAASLTTLESLEAIVGKDKLVVSTSCSLMHTAVDLVNETKLDSEIKSWLAFAAQKVVEVNALAKALAGQKDEAYFAANTAAQASRRSSPRVTNEEVQKAAAALRGSDHRRATNVSARLDAQQKKLNLPVLPTTTIGSFPQTVELRRVRREYKAKKISEDEYVSAIKEEISKVVKIQEELDIDVLVHGEPERNDMVEYFGEQLSGFAFTANGWVQSYGSRCVKPPIIYGDVSRPNAMTVFWSKMAQSMTSRPMKGMLTGPVTILNWSFVRNDQPRFETCYQIALAIKKEVEDLEAGGIQVIQIDEAALREGLPLRKAEHAFYLDWAVHSFRITNCGVQDTTQIHTHMCYSNFNDIIHSIINMDADVITIENSRSDEKLLSVFREGVKYGAGIGPGVYDIHSPRIPSTEEIADRINKMLAVLDTNILWVNPDCGLKTRKYTEVKPALTNMVLAAKLIRTQLASAK

SEQ ID NO: 2595 - protein, 898 aa, Oryza sativa
  source: /note="subsp. japonica"
MAAEHPFKNILTTLPKPGGGEYGKFYSLPALNDPRIDKLPYSIRILLESAIRNCDNFQVNQNDVEKIIDWENTSPKLAEIPFKPARVLLQDFTGVPAVVDLAAMRDAMAKLGSDANKINPLVPVDLVIDHSVQVDVARSPNAVQSNMELEFKRNNERFGFLKWGSTAFHNMLVVPPGSGIVHQVNLEYLGRVVFNTDGIMYPDSVVGTDSHTTMIDGLGVAGWGVGGIEAEATMLGQPMSMVLPGVVGFKLTGKLQNGVTATDLVLTVTQMLRKHGVVGKFVEFYGEGMGKLSLADRATIANMSPEYGATMGFFPVDHVTLDYLKLTGRSDETVAMIEAYLRANKMFVDYNEPQTERVYSSYLELDLNEVEPCISGPKRPHDRVLLKEMKSDWHSCLDNRVGFKGFAVPKEQQDKVVKFDFHGQPAELKHGSVVIAAITSCTNTSNPSVMLGAALVAKKACELGLEVKPWVKTSLAPGSGVVTKYLLQSGLQEYLNKQGFHVVGYGCTTCIGNSGDLDESVSAAISENDVVAAAVLSGNRNFEGRVHPLTRANYLASPPLVVAYALAGTVDIDFEKEPIGVGKDGKEVFFRDIWPSTEEIAEVVQSSVLPDMFKSTYEAITKGNPMWNQLTVPEASLYSWDPNSTYIHEPPYFKDMTMSPPGPHGVKNAYCLLNFGDSITTDHISPAGSIHKDSPAAKYLLERGVDRKDFNSYGSRRGNDEVMARGTFANIRIVNKFLNGEVGPKTVHVPTGEKLYVFDAALKYKSEGHDTIVLAGAEYGSGSSRDWAAKGPMLLGVKAVIAKSFERIHRSNLVGMGIIPLCFKAGEDADSLGLTGHERYTIDLPTNVSEIRPGQDITVTTDNGKSFTCTLRFDTEVELAYFNHGGILPYVIRNLAQN

SEQ ID NO: 2596 - protein, 1306 aa, Oryza sativa
  source: /note="subsp. japonica"
MASTTDADAAPVAPVLEEKPPTPPPDGDEVPSAPAAAAAAEQPKVVEEEEVRLEGKGGGFGGQEVEVAGDGEDGGEVEVAEAKDEGGGGEFAGGDAKAASSLLAAAAEEEEEEEASNGELGEEDAYPASSDAAVGEEKGELGEEPEEKAPALAPEANGAAESDVEEKPEEDNEGEEVATGGGDDGELGMEKEVDVSAGAAEAPQPEDKVAPEAEANGDLGDKAEEEASASAAVEVVEESNAPEELLEKAVVSEANGVAAAVELAVEEKLEDNKGEEEEMEAKPEPVSGVIPVVVDDTSSEMIAPVSAESAVEESTEKEQTVDDTSSEMIAHVSAESAVEESTEKEQTVESEASESVEIVGVEKPTEDESNVDGGASSVVSRELAPEETKENNVGQEDEGVAEVIDREEDADDDEEIVLAAADDEDDGTNEADDDEDGVSSDRGPARVAIIESSEAAKQIMKELGEGSASVSPVSGLSSSREYTNSMDGQIVLDDSEEDGDDDDNEDDDEKGFDSAALAALLKAATGASADGNVTVSSQDGSRIFSMDRPAGLGSSAPSLRPTVPRPVARSNLFSPSELAVTAEPTEEMTEEEKKLHDKVELIRVKFLRLVYRLGATPEETVAAQVLYRLSLAEGIRHGRQTNRAFSLDNARKKAMLLEAEGKEELNFSCNILVLGKIGVGKSATINSIFGEEKSKTDAFSSATNSVREIVGNVDGVQIRIIDTPGLRPNVMDQGSNRKILASVKKYTKRCPPDIVLYVDRLDSLSRDLNDLPLLKTITSVLGSSIWFNAIVALTHAASAPPEGLNGAPMTYEVLMAQRSHIIQQSIRQAAGDMRLMNPVALVENHPSCRRNREGQKVLPNGQSWRHQMLLLCYSSKILSEANSLLKLQDPNPGKLFGFRFRSPPLPFLLSSLLQSRAHPKLSPDQGGNEGDSDIDLDDYSDIEQDEDEEEYDQLPPFKPLTKSQLARLTKEQKNAYFDEYDYRVKLLQKKQWKDEIRRLKEMKKRGKTDMDAYGYANIAGENDLDPPPENVSVPLPDMVLPPSFDCDNPTYRYRFLEPTSTVLARPVLDAHGWDHDCGYDGVSVEETLALLNKFPANMAVQVTKDKKEFSIHLDSSISAKLGEDASSLAGFDIQTVGRQLAYILRGETKFKNIKKNKTTGGFSVTFLGDIVATGLKVEDQLSLGKRLALVASTGAMRAQGDTAYGANLEARLKDKDYPIGQSLSTLGLSLMKWRRDLALGANLQSQFSIGRGSKMVVRLGLNNKLSGQITVRTSTSEQVQIALLGLIPVAASIYRSFRPSEPSFAY

SEQ ID NO: 2597 - protein, 153 aa, Oryza sativa; identical to SEQ ID NO: 559
  source: /note="subsp. japonica"

SEQ ID NO: 2598 - protein, 168 aa, Oryza sativa
  source: /note="subsp. japonica"
MLVYQDLLTGDELLSDSFPYREIENGILWEVDGKWVVQGAIDVDIGANPSAEGGGDDEGVDDQAVKVVDIVDTFRLQEQPPFDKKQFVTFMKRYIKNLSAKLDAEKQEEFKKNIEGATKYLLGKLKDLQFFVGESMHDDGGLVFAYYKDGATDPTFLYFSHGLKEVKC

SEQ ID NO: 2599 - protein, 184 aa, Oryza sativa; identical to SEQ ID NO: 512
  source: /note="subsp. japonica"

SEQ ID NO: 2600 - protein, 200 aa, Oryza sativa
  source: /note="subsp. japonica"
MVSLRLPLILLSLLAISFSCSAAPPPVYDTEGHELSADGSYYVLPASPGHGGGLTMAPRVLPCPLLVAQETDERRKGFPVRFTPWGGAAAPEDRTIRVSTDVRIRFNAATICVQSTEWHVGDEPLTGARRVVTGPLIGPSPSGRENAFRVEKYGGGYKLVSCRDSCQDLGVSRDGARAWLGASQPPHVVVFKKARPSPPE

SEQ ID NO: 2601 - protein, 233 aa, Oryza sativa
  source: /note="subsp. japonica"
MATHTQISKKRKFVADGVFFAELNEMLTRELAEDGYSGVEVRVTPMRTEIIIRATRTQNVLGEKGRRIRELTSVVQKRFNFPENGVELYAEKVNNRGLCAIAQAESLRYKLLGGLAVRRACYGVLRFVMESGAKGCEVIVSGKLRAQRAKSMKFKDGYMISSGYPVNLYIDSAVRHVLLRQGVLGIKVKIMLDWDPKGKQGPMTPLPDLVTIHAPKDEDEFSKPLTAEIPVAA

SEQ ID NO: 2602 - protein, 305 aa, Oryza sativa
  source: /note="subsp. japonica"
MAAVAGGAARALSQAEQDVQMMLAADVHLGTKNCDFQMERYVYKRRSDGIYIINLGKTWEKLQLAARVIVAIENPQDIIVQSARPYGQRAVLKFAQYTGAHAIAGRHTPGTFTNQLQTSFSEPRLLILTDPRTDHQPIKESALGNIPTIAFCDTDSPMRYVDIGIPANNKGRNSIGCLFWLLARMVLQMRGTILPGHKWDVMVDLFFYRDPEEAKEQEEEAPAQDFAAITDYTAPEQWSADQWTSDVAAPPAATVGDWGAAPAPVAAAEGWDQAGAPVATEAAVVPPVAPTGWDPAAQPAAQGWD

SEQ ID NO: 2603 - protein, 337 aa, Oryza sativa
  source: /note="subsp. japonica"
MHKDELVEKNLKMGDVLHIDAGSTFYMVNSGKGQRLKIICSIDASDNIGFGPYQAFFLGGGGGAAAGQWRPVGRGEEEEEEEEELVVDEASSTWSWTKLVGRLLGVVGGGAPSNSVAAQPKKKKDKTVRAPEPYNLYEQGTGFRNAYGSSVAVDKHDYEPLGHSDIGVYLVNLTAGSMMAPHVNPRATEYGVVLSGTGCIEVVFPNGSKAMSATVRAGDVFYIPRYFPFCQVASRGGPFVFFGFTTSARRNHPQFLVGGSSVLRALLGTELAAAFGVPEKAMRKLVLAQNEAVILPSWPEKKKKKKWEEEPEDERWEEKKKAAKQRKPWVIEQVPAK

SEQ ID NO: 2604 - protein, 376 aa, Oryza sativa
  source: /note="subsp. japonica"
MAMWRAAAGHLLGRALGSRAAHTSAGSKKIVGVFYKGGEYADKNPNFVGCVEGALGIREWLESKGHHYIVTDDKEGLNSELEKHIEDMHVLITTPFHPAYVSAERIKKAKNLELLLTAGIGSDHIDLPAAAAAGLTVAEVTGSNTVSVAEDELMRILILLRNFLPGYQQVVHGEWNVAGIAYRAYDLEGKTVGTVGAGRIGRLLLQRLKPFNCNLLYHDRLKIDPELEKEIGAKYEEDLDAMLPKCDVIVINTPLTEKTRGMFNKERIAKMKKGVIIVNNARGAIMDTQAVADACSSGQVAGYGGDVWFPQPAPKDHPWRYMPNHAMTPHISGTTIDAQLRYAAGVKDMLDRYFKGEDFPVQNYIVKEGQLASQYQ

SEQ ID NO: 2605 - protein, 393 aa, Oryza sativa
  source: /note="subsp. japonica"
MSSDDEVREEKELDLSSSDVVTKYKDAADIINNALKLVVSLCKPKAKIVDICEKGDSYIREQTGNIYKNVKRKIERGVAFPTCVSVNNTVCHFSPLATDEAVLEENDMVKIDMGCHIDGFIAVVAHTHVIHDGAVTGKAADVLAAANTAAEVALRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLLPSGSQRVTSHSLQELQPTKSIEDNAEIKAWLALGTKTKKKSGAKKKKGKKGDAAEAVPMEEGSNDANKE

SEQ ID NO: 2606 - protein, 389 aa, Oryza sativa
  source: /note="subsp. japonica"
MSHRKFEHPRHGSLGFLPRKRSSRHRGKVKSFPKDDVSKPCHLTSFVGYKAGMTHIVREVEKPGSKLHKKETCEAVTIIETPPLVIVGLVAYVKTPRGLRSLNSVWAQHLSEEVRRRFYKNWCKSKKKAFTKYALKYDSDAGKKEIQMQLEKMKKYASIVRVIAHTQIRKMKGLKQKKAHLMEIQINGGTIADKVDYGYKFFEKEIPVDAVFQKDEMIDIIGVTKGKGYEGVVTRWGVTRLPRKTHRGLRKVACIGAWHPARVSYTVARAGQNGYHHRTEMNKKVYKIGKSGQESHAACTEFDRTEKDITPMGGFPHYGVVKGDYLMIKGCCVGPKKRVVTLRQSLLKQTSRLALEEIKLKFIDTSSKFGHGRFQTTDEKQRFFGKLKA

SEQ ID NO: 2607 - protein, 531 aa, Oryza sativa
  source: /note="subsp. japonica"
MKTASMAASLLIPLCLCILLLRGASAVSDQQEAGRRDSCDRIDRRIRALEPTRRVDSEAGHTELYDDRDGQLPCAGVAAARITIQRNGLLLPSYSNSPRLAYIVHGRGIVGVVIPGCPETYQETSSSSSQEQEDDERRRRGRRGDEERRRSSEGEEEEEEETSRRSFEQSIRDEHQRITTVRQGDVVAIPAGAPFWVHNDGDSPLVAISVHDVSNNANQLDQTSRRFRLAGGQARSEGRQRYGEGESSESETERGGEESYNILSGFDTELLAESMRVSPDIARKLQGRSDKRGNIVRVRRGGLRMLRPATERVTDEEMMRGANAAAAAGNGIDEAVCLMKLRENVADPMKADLYTPNGGRITVLNSQKLPVLKLIKMSVNRGVMRRNAILAPHWNINAHAAVYATSGSARLQVVSSEGRRVFDGELRRGQMVVVPQSFAVAGRAGDEGFAWVSFQTSDGAMNAPVVGKSSALRGMPADVLDNAFGVSREEARMVKFGRGQELAIFSPKSGAAARRRRSPGHRDDGVLAAPA

SEQ ID NO: 2608 - protein, 549 aa, Oryza sativa
  source: /note="subsp. japonica"
MSSEPPPDAAAAAASSAGDLAADLSSATISKKQLKKDARKAEKAEKASQRQQQQQPQADADDPFAANYGDVPVEEIQSKTISGRVWTEIGGLDEAAAGRSVLIRGAAQAIRPVSKKMAFVVLRESMSTVQCVLVASADAGVSTQMVRFATSLSKESIVDVEGVVSLPKEPLKATTQQVEIQVRKIYCINRAIPTLPINLEDASRSEAEIEKAEQAGEKLVRVGQDTRLNYRAIDLRTPANQAIFRIQCQVENKFREYFLSKNFVGIHSPKLIAGSSEGGAAVFKLQYNGQPACLAQSPQLYKQMAICGGFERVFEVGPVFRAENSNTHRHLCEFVGLDAEMEIKEHYFEVCDIIDGLFVAIFKHLNENCKKELETINRQYPFEPLKYLEKTLKLTYEEGIQMLKEAGTEIEPMGDLNTEAEKKLGRLVKEKYGTEFFILYRYPLAVRPFYTMPCYDNPAYSNSFDVFIRGEEIISGAQRIHLPELLTKRATECGIDASTISSYIESFSYGAPPHGGFGVGLERVVMLFCALNNIRKTSLFPRDPQRLVP

SEQ ID NO: 2609 - protein, 578 aa, Oryza sativa
  source: /note="subsp. japonica"
MAASTTLALSHPKTLAAAAAAAPKAPTAPAAVSFPVSHAACAPLAARRRAVTAMVAAPPAVGAAMPSLDFDTSVFNKEKVSLAGHEEYIVRGGRNLFPLLPEAFKGIKQIGVIGWGSQGPAQAQNLRDSLAEAKSDIVVKIGLRKGSKSFDEARAAGFTEESGTLGDIWETVSGSDLVLLLISDAAQADNYEKIFSHMKPNSILGLSHGFLLGHLQSAGLDFPKNISVIAVCPKGMGPSVRRLYVQGKEINGAGINSSFAVHQDVDGRATDVALGWSVALGSPFTFATTLEQEYKSDIFGERGILLGAVHGIVEALFRRYTEQGMDEEMAYKNTVEGITGIISKTISKKGMLEVYNSLTEEGKKEFNKAYSASFYPCMDILYECYEDVASGSEIRSVVLAGRRFYEKEGLPAFPMGNIDQTRMWKVGEKVRSTRPENDLGPLHPFTAGVYVALMMAQIEVLRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVPANADFVRPELRQSS

SEQ ID NO: 2610 - protein, 563 aa, Oryza sativa
  source: /note="subsp. japonica"
MRSRSLLLVALATLLLHASASASDDDLDYLIDNADDIPANDPDGWLQEGSPDDDDDDDLFHHGQAQDHPIDETHVFLLSAANFSDFLASHRHVMVEFYAPWCAHCQALAPDYAAAAADLSPLAHQVALAKVDATEDTDLAQKYDVQGFPTILFFIDGVPKDYNGARTKEAIVSWVNKKLAPGVQNITTVDEAEKILTGEDKAILAVLDSLSGAHSDEIAAASRLEDAINFYQTSNPDVAKLFHLDPAAKRPSLVLLKKQEEEKLTFYDGPFKASAIADFVSANKLPLVNTLTQETAPSIFDNPIKKQILLFVVANESSKFLPIFKEASKSFKGKLLFVFVERDNEEVGEPVANYFGITGQETTVLAYTGNEDARNFFLDGEISVENIKRFAEDFLEEKLTPFYKSEPVPESNEGDVKIVVGKNLDQIVLDESKDALLEIYAPWCGHCQELEPTYNKLGKHLRGIDSLVIAKMDGTANEHPRAKPDGFPTILFYPAGKKSFEPITFEGDRTVVEMYKFIKKHASIPFKLKRPDSSATKTEKDQSTASTNLRGERSSGTNFKDEL

SEQ ID NO: 2611 - protein, 986 aa, Oryza sativa
  source: /note="subsp. japonica"
MASATGASGWLRGKVKGVTSGDCLLIMGSTKADVPPPEKSITLSYLMAPRLARRGGVDEPFAWESREFLRKLCIGKEVTFRVDYTAPNVGREFGTVYLGDKNVAYSIIAAGWARVKEQGPKGGEPSPYLTELLRLEEVAKQQGLGRWSKEPGAAEESIRDLPPSAIGEASGFDAKGFAVANKGKSLEAIVEQVRDGSTVRVYLLPSFQFVQIYVAGVQSPSMGRRPPNPTVVAAAESTADGATNGGDSEEAPAPLTTAQRLAAAAVSTEIPPDRFGIEAKHFTETRVLNRDVRIVVEGTDSFSNIIGSVYYSDGDTLKDLALELVENGLAKYVEWSANMMDVDAKIKLKNAELQAKKDQLRIWTGFKPPVTNSKPIHDQKFTGKVVEVVSGDCIIVADDAAPYGSPSAERRVNLSSIRAPKMGNPRRDEKPDNFAREAKEFLRTRLIGKQVTVEMEYSRRISTVDGQPTTNTADARVLDYGSVFLGSPSQADGDDVSSIPSSGNQPGINIAETLLSRGFARTSKHRDYEERSHYFDLLLAAESRAEKAKKGVHSAKESPVMHITDLTTVSAKKARDFLPFLQRNRRHSAIVEYVFSGHRFKLTIPKETCSIAFSFSGVRCPGKDEPYSNEAIALMRRRILQRDVEIEVEAVDRTGTFLGSLWESKTNMASVLLEAGLAKLSSFGLDRIPDANVLMRAEQSAKQQKLKIWENYVEGEEVSNGSASESKQKEILKVVVTEVLGGGKFYVQTVGDHRVASIQQQLASLKLKDAPVIGAFNPVKGEIVLAQFSADNSWNRAMIVNGPRGAVSSQDDKFEVFYIDYGNQEVVPYSRIRPADPSISSSPALAQLCSLAFIKVPNLEDDFGHEAAVYLNDCLLNSQKQYRAMIEERDTSGGKSKGQGTGTILIVTLVDAETETSINATMLEEGLARLERSKRWDTRERKAALQNLEQFQEKAKKERLQIWQYGDVESDEEEQAPAARRTGGRR

SEQ ID NO: 2612 - protein, 220 aa, Oryza sativa
  source: /note="subsp. japonica"
MPGLTIGDTVPNLELDSTHGKIRIHDFVGDTYVILFSHPGDFTPVCTTELAAMAGYAKEFDKRGVKLLGISCDDVQSHKDWIKDIEAYKPGNRVTYPIMADPSREAIKQLNMVDPDEKDSNGGHLPSRALHIVGPDKKVKLSFLYPACVGRNMDEVVRAVDALQTAAKHAVATPVNWKPGERVVIPPGVSDDEAKEKFPQGFDTADLPSGKGYLRFTKVG

SEQ ID NO: 2613 - protein, 219 aa, Oryza sativa
  source: /note="subsp. japonica"
MGRRPARCYRQIKNKPYPKSRYCRGVPDPKIRIYDVGMKKKGVDEFSHCVHLVSWEKENVTSEALEAARIACNKYMTKSAGKDAFHLRVRVHPFHVLRINKMLSCAGADRLQTGMRGAFGKPQGTCARVDIGQVLLSVRCKPNNAVHASEALRRAKFKFPGRQKIIESRKWGFTKFSRDEYVRLKSEGRIMPDGVNAKLLGCHGRLSARAPGKAFLSAA

SEQ ID NO: 2614 - protein, 258 aa, Oryza sativa
  source: /note="subsp. japonica"
MAPKRGGRAPVPAKKKTEKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAEAEGKTVEAKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGVMGSKSQAKTKAREKLLAKEAAQRMT

SEQ ID NO: 2615 - protein, 304 aa, Oryza sativa
  source: /note="subsp. japonica"
MSLQGGFVKTQKTHAYFKRFQVKFKRRRQGKTDYRARIRLTNQDKNKYNTPKYRFVTNKDITAQIVYATIAGDIVMAAAYSHELPRYGLEVGLTNYAAAYCTGLLLARRVLTLRGLDQEYEGNVEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMESLYKKVHAAIRADPTMAKSTKKEPATHKRYNLKKLTYEQRKASLVERLNALNSSAGADDDDEEEDDE

SEQ ID NO: 2616 - protein, 343 aa, Oryza sativa
  source: /note="subsp. japonica"
MFGFGHHHNQAPAAPSDPNQIFKIFCRANENYCLTVRDSAVVLAPVNPKDEHQHWFKDMRFSTKVKDGEGMPAFALVNKATGLAVKHSLGQSHPVKLVPFNPEYEDASVLWTESKDVGKGFRCIRMVNNTRLNLDAFHGDKDHGGVRDGTTVVLWEWCKGDNQSWKILPWGPEAHSSSPGAATACTIGGVPVHTVRVFSAAGEDYCLTVRNGTACLAPKNPRDDYQHWIKDMRHSNKIRDEEGYPAFALVNKVTGEAIKHSTGQGHPVKLVPYNPEYQDESVLWTESKDVGKGFRCIRMVNNIYLNFDAFHGDKDHGGIHDGTEIVLWKWCEGDNQRWKILPW

SEQ ID NO: 2617 - protein, 391 aa, Oryza sativa
  source: /note="subsp. japonica"
MAPPPYAAAVVVATVAVLVLVSQVSVAAGADCRFPAVFNFGDSNSDTGGLSATFGAAPPPNGRTFFGMPVGRYCDGRLVIDFIAESLGLPYLSAYLNSIGSNFTQGANFATAGSSIRRQNTSLFLSGFSPISLDVQSWEFEQFINRSQFVYNNKGGIYRELLPKAEYFSQALYTFDIGQNDITTGFFINMTSEQVIAYIPDLMERLTNIIQNVYGLGGRYFWIHNTGPIGCLPYAMVHRPDLAVVKDGSGCSVAYNEVAQLFNQRLKETVGHLRKTHADAAFTYVDVYSAKYKLISDAKKLGMDDPMLTCCGYGGGRYNFDDRVGCGGKVKVNGTWVVAGKSCDDPLKRVSWDGVHFTEAANKFVFDQIAGGKLSDPPVPLRQACQISRGQ

SEQ ID NO: 2618 - protein, 912 aa, Oryza sativa
  source: /note="subsp. japonica"
MNPDNFTHKTNEALVAAHEIASEAGHAQLTPLHLVAALAADKGGILRQAISQASGGDAGAPDSFERVVSGALKKLPSQSPPPDSVPASTALIKVIRRAQSAQKKRGDSHLAVDQLLLGLLEDSLISDCLKEAGVSAARVRAELEKLRGGEGRKVESASGDTNFQALKTYGRDLVEQAGKLDPVIGRDEEIRRVVRILSRRTKNNPVLIGEPGVGKTAVVEGLAQRIVRGDVPSNLLDVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVFVAEPSVPDTISILRGLKEKYEGHHGVRIQDRALVVAAQLSARYIMGRHLPDKAIDLVDEACANVRVQLDSQPEEIDNLERKRIQLEVEHHALEKEKDKASKARLVEVKKELDDLRDKLQPLTMKYRKEKERIDEIRKLKQRREELQFTLQEAERRMDLARVADLKYGALQEIDVAIAKLESETGENLMLTETVGPEQIAEVVSRWTGIPVTRLGQNDKERLVGLADRLHQRVVGQAEAVSAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVIFDPLSHEQLRKVARLQMKDVAVRLAERGVALAVTDAALDVILSLSYDPVYGARPIRRWIEKRVVTQLSKMLIQEEIDENCTVYIDAAPHKDELAYRVDNRGGLVNAETGQKSDILIQVPNGAATGSDAAQAVKKMRIMEDEDGMDEE

SEQ ID NO: 2619 - protein, 148 aa, Oryza sativa
  source: /note="subsp. japonica"
MASKNLLLSAAVLLSVLAIAAAAATASAATTSCQPGMAIPHDPLRGCRRYVLRRACGLAAGGRLYDWSLKERCCQELAAVPAYCRCAALAYFMDGASEGRLLEDLPGCPRETQRGLAAMLTTPGECNLETIHGGPYCLELTDREMPKY

SEQ ID NO: 2620 - protein, 150 aa, Oryza sativa
  source: /note="subsp. japonica"
MSLVRRSNVFDPFSLDLWDPFDSVFRSVVPATSDNDTAAFANARIDWKETPESHVFKADLPGVKKEEVKVEVEEGNVLVISGQRSKEKEDKNDKWHRVERSSGQFMRRFRLPENAKVDQVKAGLENGVLTVTVPKAEVKKPEVKAIEISG

SEQ ID NO: 2621 - protein, 290 aa, Oryza sativa
  source: /note="subsp. japonica"
MGLVHALLPFAAAAALLLLAAPPPATADDPGLAVYWGRHKEEGSLREACDTGRYTTVIITFYNAFGHGRYSLDISGHPLAAVGADIKHCQSRGITVLLSIGGQGGAYSLPTNASAADVADNLWNAYLGGHRAGVARPFGDDAAVDGIDFFIDQGGADHYDDLARRLDGYNKYYRGRVGVLLTATTRCSYPDHRLEKALATGVFARIHVRMFGDEQCTMSPRYSWEKWAAAFPGSKVYIGLVASPEQDSAWMFQKDLYYEMLQFVRSLPNYGGLAIYDRYFDKKANYTGEG

SEQ ID NO: 2622 - protein, 319 aa, Oryza sativa
  source: /note="subsp. japonica"
MAIKRTKAEKKVAYDKKLCQLLDEYTKVLIAVADNVGSNQLQEIRKGLRGDSIVLMGKNTLIRRCIKVHADNTGNKEFLELMPLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLVITNVYDSGSVFSPEVLDLTEDDLMEKFASGVSMVASVSLAISYPTIAAAPHMFLNGYKNVLAVAVETEYSYPHADKIKEYLKDPSKFAVAAPVAADSGAAAPSAAKEEEKKEEPEEESDGDLGMSLFD

SEQ ID NO: 2623 - protein, 317 aa, Oryza sativa
  source: /note="subsp. japonica"
MAAAASAPPAPADALPKGADSFFRTVISNMEKVYLSRNPTAKTILELVRSYDGDHICYDHFAFRTFGVDGYGIKSLAEFFTDFGYVPREELRFPAKKLRALWFSPPTNDGYTGTGVYGPLPRIFISELLVDELSPQSQDIIQKYIRTSGKGNKHATLASTSGELTWEKPIYSDFQVLSRESEYAAWTLVNGYALNHTTISTHRLISDIRSINKFNKFVEDNGFKLNSEGGILKVSPDGLLQQSSTVADSALFTFADGITESIPRSYIEFAERLVLPQFKDLPNDEVNEHHRRDGFEVGNADKIFESTSNDQLTRRSA

SEQ ID NO: 2624 - protein, 370 aa, Oryza sativa
  source: /note="subsp. japonica"
MSSSLLTDLVNLDLSESTDKVIAEYIWVGGTGMDVRSKARTLSGPVDDPSKLPKWNFDGSSTGQATGDDSEVILHPQAIFRDPFRKGKNILVMCDCYAPNGEPIPTNNRYNAARIFSHPDVKAEEPWYGIEQEYTLLQKHINWPLGWPLGGYPGPQGPYYCAAGADKSYGRDIVDAHYKACLFAGINISGINAEVMPGQWEFQIGPVVGVSAGDHVWVARYILERITEIAGVVVSFDPKPIPGDWNGAGAHTNYSTKSMRSNGGYEVIKKAIKKLGMRHREHIAAYGDGNERRLTGRHETADINNFVWGVANRGASVRVGRDTEKDGKGYFEDRRPASNMDPYLVTAMIAETTILWEPSHGHGHGQSNGK

SEQ ID NO: 2625 - protein, 381 aa, Oryza sativa
  source: /note="subsp. japonica"
MSHRRVDAAACDSWRPPPTPPPPHARRALALRVGGGGGGPAFASLTVREGGGGGEEGEVGEGKGKQQQLPAAGVLVRHPLAMLALVPNAVALFAAGAAAGAVAKTITAPLDRVKLLMQTHSVRVVGESTKKGIGFLEAIAEIGKEEGLKGYWKGNLPQVIRIVPYSAVQLFSYEVYKKFFRRKDGELTVFGRLAAGACAGMTSTLVTYPLDVLRLRLAVQSGHSTMSQVAMNMLRDEGLASFYGGLGPSLIGIAPYIAVNFCVFDLMKKSVPEKYKSRPETSLATALLSATFATLMCYPLDTVRRQMQMKGSPYNTVLDAIPGIVERDGLIGLYRGFVPNALKNLPNSSIKLTAFDTVKTLISTGQKELEKLMQENQEKMS

SEQ ID NO: 2626 - protein, 447 aa, Oryza sativa
  source: /note="subsp. japonica"
MREILHIQGGQCGNQIGAKFWEVICDEHGIDHTGKYSGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMLNVQNKNSSYFVEWIPNNVKSSVCDIPPNGLKMASTFIGNSTSIQEMFRRVSEQFTAMFRRKAFLHWYTGEGMDEMEFTEAESNMNDLVAEYQQYQDATADDEEEDYGDEEEDEVAA

SEQ ID NO: 2627 - protein, 451 aa, Oryza sativa
  source: /note="subsp. japonica"
MRECISIHIGQAGIQVGNACWELYCLEHGIQPDGQMPGDKTVGGGDDAFNTFFSETGAGKHVPRAVFVDLEPTVIDEVRTGDYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDIKFDLMYSKRAFVHWYVGEGMEEGEFSEAREDLAALEKDYEEVGSEFDDGDEGDEGDEY

SEQ ID NO: 2628 - protein, 486 aa, Oryza sativa
  source: /note="subsp. japonica"
MAVSSSSLLLRRGATGGAGRRWGPGEALRRLVSSSEAAPAEKVPARSPPVMPPFEHRPRPYAGWSGDEILAKRKQFLGSSVFYYYQKPLNIVEGKMQYLYDENGKRYLDCFGGIVTVSCGHCHPDIVNAVVEQTKLLQHTTTIYLNQPIVEFAEALASKMPGNLKVVYFVNSGTEANELAMLMARLYSGNLNMIALRNAYHGGSAGTIGLTGLQTWKYPIPQGEIHHVMNPDPYRGTFGSDAVAYAKEVEEQINYGTSGRVAGFIAETFQGVGGAVELAPGYLKLAYDTVRKAGGVCIADEVQSGFGRTGSHYWGFQTQDVIPDIVTMAKGIGNGLPLGAVVTTPEIANVLAQKIQFNTFGGNPVCSVGGLAVLKVLDKEKRQAHCADVGSHLVNRLKELQQKHEIIGDVRGRGLMLGVELVTDRKEKTPAKAETNLLFEKLKDLNILVGKGGLHGNVFRIKPPMCFTRDDADYLVDAMDYAMSGL

SEQ ID NO: 2629 - protein, 509 aa, Oryza sativa
  source: /note="subsp. japonica"
MGSFARKEHQFLAELGLAPRNPGSFACGAWGGSGPVVTSTNPTNNQVIAEVVEASAREYEEGMRACYDAAKTWMAIPAPKRGEIVRQIGDALRAKLHHLGRLVSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLERNNLPGSIFTAFCGGADIGQAISLDTRIPLVSFTGSTKVGLMVQQQVNARFGKCLLELSGNNAIIVMDDADIQLAVRSVLFAAVGTAGQRCTTCRRLLLHESIYRTFLDQLVEVYKQVRIGDPLENGTLLGPLHTPASRDAFLKGIQTIRSQGGKILYGGSAIESEGNFVQPTIVEISPSAPVVREELFGPVLYVMKVQNLKEAVEINNSVPQGLSSSIFTKRPDIIFKWIGPHGSDCGIVNVNIPTNGAEIGGAFGGEKATGGGREAGSDSWKQYMRRATCTINYGSELPLAQGINFG

SEQ ID NO: 2630 - protein, 609 aa, Oryza sativa
  source: /note="subsp. japonica"
MASHALRLHPLLFSAAAARPAPLAARPGGGARRVHRRHSLAVVRCSSSAAQALKIKSIPTKPVEGQKTGTSGLRKKVKVFQQENYLANWIQALFNSLPPEDYVGGTLVLGGDGRYFNKDAAQIITKIAAGNGVGKILVGRNGLLSTPAVSAVIRKRQANGGFIMSASHNPGGPDNDWGIKFNYSSGQPAPETITDQIYGNTLSISEIKTADIPDVDLSSLGVVSYGDFTVEVIDPVLDYLELMENVFDFQLIKGLLSRPDFRFVFDAMHAVTGAYADPIFVEKLGADPDYILNGVPLEDFGNGHPDPNLTYAKELVFTMFGSGAPDFGAASDGDGDRNMILGRRFFVTPSDSVAIIAANAQAAIPYFQSGPKGLARSMPTSGALDRVADKLNVPFFEVPTGWKFFGNLMDAGKLSICGEESFGTGSDHIREKDGIWAVLAWLSILAHRNKDKKAGERLVSVEDVAREHWATYGRNFFSRYDYEECESESANKMMEHLRDVIAKSKPGEKYGNYTLQFADDFSYTDPVDGSTVSKQGLRFVFTDGSRIIFRLSGTGSAGATIRIYIEQFESDASKHDLDAQIALKPLIDLALSVSKLKDFTGRDKPTVIT

SEQ ID NO: 2631 - protein, 654 aa, Oryza sativa
  source: /note="subsp. japonica"
MAPALSRSLGASSVAALRPTPSRGRGPTLRSAVAVQGRGAAAVAARGVRWEAGRRKGKGRMVGVRCEAAVTEKPAGEEEAAGEQFEYQAEVSRLLDLIVHSLYSHKEVFLRELVSNASDALDKLRFLSVTDSSVLSDGGELEIRIKPDPEAGTITITDTGIGMTKDELKDCLGTIAQSGTSKFLKALKENKDLGADNGLIGQFGVGFYSAFLVAEKVVVSTKSPKADKQYVWEAMADSSSYVIKEETDPEKMLTRGTQITLFLRDDDKYEFADPGRIQGLVKNYSQFVSFPIYTWQEKSRTVEVEEEEPKEGEEATEGEKKKKKKTITEKYWDWELANETKPIWMRNPKEVEKTEYNEFYKKAFNEFLDPLAYTHFTTEGEVEFRSVLYIPGMAPLSNEEIMNPKTKNIRLYVKRVFISDDFDGELFPRYLSFVKGVVDSNDLPLNVSREILQESRIVRIMRKRLVRKTFDMIQEIAEKEDKEDYKKFWESFGKFVKLGCIEDTGNHKRLAPLLRFYSSKNETDLISLDQYVENMPENQKAIYYIATDSLQSAKTAPFLEKLVQKDIEVRARFLFTIYQRFVVCLCYSSGSEAHFSFFRFSTLSSRLMRLPFRIYRHTKRKNLLISAKKTWNWVMKMRTRKMRASRNTLFYVTG

SEQ ID NO: 2632 - protein, 988 aa, Oryza sativa
  source: /note="subsp. japonica"
MELALASAKPSPSPAPAPLLFAPLKPLPLLRFPPRRPRASSSSVGARLRAGRRGLRLLCRAAVGAGEEVFGPRRELAGVQPLVEALPPAARTAAELAVAAAAVAAGYGIGLRAGGGSRAVAVAGAAVLGAASVAGAAAVNSVVPEVAAVGLHNYVAGCDDPTKLESGEVEALATKYGVSTQDAAFKAELCDLYARFLYSVLPPGDEDLKGDEVQTIIKFKNALGLDDVDAANMHMEAFQKLIYVSNLVFGDASTFLLPWKRLFGVTDSQIDIAMRENAKILYASQLKSIGRGLDIGTLIEVRRAQLAYKLSDEIAAEMFKEHAKKLVQENISSALDIEYPTQVIEDVKSILAFNSLLITLSKHPDQDRFIRGLGPISLGGESDHDRRADDLKLLYRAYATEVLSDGHLDDEKLAPLNQLRNIFGLGKREAESIMSDVKAQVYRKRLAKSFNSELAAAPSKAAFLQNICEELQFDPELASKMHEDIYRQKLQQFVADGELNKDEVEALMAFQVRLCIPQETVDAVHSEICGKLFEKVVVEAISSVDGYDTNRRQAVKKAAQGLNLKNESVMAIFSKVVRKLFLNYIQRAKAAGNRIETAKELKKMISFNTVVVSELLADIKGEPTTAEPQTSDATSEPEVSESEGDDEYEWEQLETLRKTRPDKELREKLAKSSQKEITLKDDIPLRDRAELYETYLVFCVTGETTNVSFGTAISTKKDNSEYLMLKQLGDILGLTRKEAQNVHIKMAEKAFVQQAEVILADGKLTEAKADQLAKIQKQVGLPTEYAQKIIKNITTTKLSSAIEASISRGQIGIQQVRGLKEANFQLDSLIAEPLRENIYKKSVEEIFSSGTGEFDEEEVYVKIPADLIINAEKAKSIVQDIAKIRLDNALVQAVALLRQKKKDEVVASLNDLLACDAAVPASKPLSWPTSGELDDLYGIYMKSIPKPEKLSRLQYLLGISDEKAGQIRDAASAGTLSVATEEEDELVF

SEQ ID NO: 2633 - protein, 154 aa, Oryza sativa
  source: /note="subsp. japonica"
MADVEVETEVAAGAQPKKRTFRKYSYRGVDLDALLDMSTDDLVQLFPARARRRFQRGLKRKPMALIKKLRKAKKDAPAGEKPEPVRTHLRNMIIVPEMIGSIVGVYNGKTFNQVEIKPEMIGHYLAEFSISYKPVKHGRPGIGATHSSRFIPLK

SEQ ID NO: 2634 - protein, 161 aa, Oryza sativa
  source: /note="subsp. japonica"
MSLIRRSNVFDPFSLDLWDPFDGFPFGSGGSSSGSIFPSFPRGASSETAAFAGARIDWKETPEAHVFKADVPGLKKEEVKVEVDDGNILQISGERNKEQEEKTDQWHRVERSSGKFLRRFRLPDNAKPEQIKASMENGVLTVTVPKEEAKKPDVKSIQISG

SEQ ID NO: 2635 - protein, 160 aa, Oryza sativa
  source: /note="subsp. japonica"
MAEQTERAFLKQPKVFLCPKKTTKGKKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAGKKVFTAA

SEQ ID NO: 2636 - protein, 152 aa, Oryza sativa
  source: /note="subsp. japonica"
MSLIAGEDFQHILRLLNTNVDGKQKIMFALTSIKGVGRRFSNIACKKADIDMNKRAGELTPEELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 2637 - protein, 171 aa, Oryza sativa
  source: /note="subsp. japonica"
MVKYSREANNPTKSSKAMGRDLRVHFKNTRETAFAIRKLPLGKAKRYLEDVIAHKQAIPFRRYCGGVGRTAQAKSRHSNGQGRWPAKSARFILDLLKNAESNAEVKGLDVDTLYVSHIQVNQAQKQRRRTYRAHGRINPYMSSPCHIELILSEKEEPVKKEPESQIAARKA

SEQ ID NO: 2638 - protein, 220 aa, Oryza sativa
  source: /note="subsp. japonica"
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAEGQDAEATTEEAKKSNHVVRKLEKRQQGRTLDAHIEEQFGSGRLLACISSRPGQCGRADGYILEGKELEFYMKKLQRKKGKGASA

SEQ ID NO: 2639 - protein, 229 aa, Oryza sativa
  source: /note="subsp. japonica"
MAVSFTNVSSEAGLKKLDEYLLTRSYISGYQASNDDLAVYSAFSTAPSSSYTNVARWFTHIDALLRLSGVTADGQGVKVESTAVPSASTPDVADAKAPAADDDDDDDVDLFGEETEEEKKAAEERAAAVKASGKKKESGKSSVLLDVKPWDDETDMTKLEEAVRNVKMEGLLWGASKLVPVGYGIKKLQIMMTIVDDLVSVDSLIEDYFYTEPANEYIQSCDIVAFNKI

SEQ ID NO: 2640 - protein, 221 aa, Oryza sativa
  source: /note="subsp. japonica"
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNLHFVEAVALKPPEVPIDLAMQQQHEAELAAAAAQPLPDDDDDLIE

SEQ ID NO: 2641 - protein, 221 aa, Oryza sativa
  source: /note="subsp. japonica"
MGISRDSMHKRRATGGKQKAWRKKRKYELGRQPANTKLSSNKTVRRVRVRGGNLKWRALRLDTGNYSWGSEAVTRKTRILDVVYNASNNELVRTQTLVKSAIVQVDAAPFKQWYLTHYGVDIGRKKKAPAAKKDAAEGQEGEAATEEAKKSNHVVRKLEKRQQTRTLDSHIEEQFGSGRLLACISSRPGQCGRADGYILEGKELEFYMKKLQRKKGKGAAA

SEQ ID NO: 2642 - protein, 250 aa, Oryza sativa
  source: /note="subsp. japonica"
MKFNIANPTTGCQKKLEIDDDQKLRAFFDKRISQEVSGDALGEEFKGYVFKIMGGCDKQGFPMKQGVLTAGRVRLLLHRGTPCFRGYGRRDGERRRKSVRGCIVSQDLSVINLVIVKKGENDLPGLTDTEKPRMRGPKRASKIRKLFNLSKDDDVRKYVNTYRRTFTTKNGKKVSKAPKIQRLVTPLTLQRKRARIADKKKRIAKKKSEAAEYQKLLAQRLKEQRERRSESLAKRRSKLSSAAKAAATTA

SEQ ID NO: 2643 - protein, 261 aa, Oryza sativa
  source: /note="subsp. japonica"
MAVGKNKRISKGRKGSKKKTVDPFSKKDWYDIKAPTVFSVRNIGKTLVSRTQGTKIASEGLKHRVFEVSLADLQNDEDQAYRKVRLRAEDVQGRNVLTNFWGMSFTTDKLRSLVKKWQTLIEAHVDVKTTDNYMLRLFCIGFTKRRPNQVKRTCYAQASQIRQIRRKMVEIMANQASTCDLKELVSKFIPEVIGKEIEKSTSSIFPLQNVFIRKVKILKAPKFDLGKLMEVHGDYKEDVGMKLDRPAETDEAVAGEVAAAE

SEQ ID NO: 2644 - protein, 274 aa, Oryza sativa
  source: /note="subsp. japonica"
MAERGGERGGERGGFGRGFGRGGRGDRGGRRGGRRGPRQEEEKWVPVTKLGRLVKEGRFSKIEEIYLHSLPVKEHQIVETLVPGLKDEVMKITPVQKQTRAGQRTRFKAFVVVGDNNGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPDFWRDTKFVKSPFQEYTDLLAKPTKALMIDAPVENVEA

SEQ ID NO: 2645 - protein, 300 aa, Oryza sativa
  source: /note="subsp. japonica"
MASQQFPPQNQETQPGKEHAMDPRPEAIIQSYKPANKLKDKVAIVTGGDSGIGRAVCLCFALEGATVAFTYVKGQEEKDAEETLRALRDIRARTGAKDPMAIPADLGYDDNCRKVVDEVAGAYGGAIDILVNNAAEQYERPSITDITEDDLERVFRTNIFSYFFMSKHAVKRMRDRRGGAGAGGCSIINTSSINAYKGNKTLLDYTATKGAIVAFTRALALQLAEEGIRVNGVAPGPIWTPLIPASFAEEKVRQFGSQVPMGRAGQPSEVAPSFVFLASDDASYMSGQMLHVNGGVIVNG

SEQ ID NO: 2646 - protein, 340 aa, Oryza sativa
  source: /note="subsp. japonica"
MRPSLLRYAAQALRRRDYSSAAAAAERKVAILGAAGGIGQPLALLMKLNPLVSSLSLYDIAGTPGVAADVSHINSPALVKGFVGEEQLGEALEGSDVVIIPAGVPRKPGMTRDDLFNINAGIVKGLCTAISKYCPNALVNMISNPVNSTVPIAAEVFKKAGTYDEKKLFGVTTLDVVRAKTFYAGKANVPVTEVNVPVVGGHAGITILPLFSQATPASNALSHEDIKALTKRTQDGGTEVVEAKAGKGSATLSMAYAGAVFADACLKGLNGVPDVVECSFVQSTVTELPFFASKVRLGKNGVEEVLGLGQLSEFEKEGLENLKGELKSSIEKGIKFAHAN

SEQ ID NO: 2647 - protein, 375 aa, Oryza sativa
  source: /note="subsp. japonica"
MEKIQVTTPMADSSFNPEFLQAHAELWNLTFSYLKAMALECAIKLGIPNAIHRCGGSASLSELVISIPVPETRKPHLPRLMRFLAAVGVFSLDNPTIDEEVTEKGMGIYRLTPLSRLLVDGSIGGHGSLSPFVLSQTTKYHVSAAMNLSDWFMTEDKEVAIEMPFRAAHGTDLWGVMSRDANMNEVFNAGMGSDSRLAINFIISKCGEVFEGISSLVDVGGGTGTTARDIAKAFPHIKCSVLDLPNVIDTITVDGIIEYIAGDMMEQIPPTDAVLLKYILHDWNDEDCVKILKQCRNAIHAQKPGGKVIIIDIVVGSPSKDMFEAQVSFDLLMMVITSGKERDQHEWHKIFMDAGFSHYKTRPVLGFLAITELYP

SEQ ID NO: 2648 - protein, 396 aa, Oryza sativa
  source: /note="subsp. japonica"
MAADLRVSIAHQTSFALRLAAALSSPAHPAGGAGRNVAFSPLSLHVALSLVAAGAGGATRDQLASALGGPGSAEGLHAFAEQLVQLVLADASGAGGPRVAFADGVFVDASLSLKKTFGDVAVGKYKAETHSVDFQTKAAEVASQVNSWVEKVTSGLIKEILPPGSVDHTTRLVLGNALYFKGAWTEKFDASKTKDGEFHLLDGKSVQAPFMSTSKKQYILSYDNLKVLKLPYQQGGDKRQFSMYILLPEAQDGLWSLAEKLNSEPEFLEKHIPTRQVTVGQFKLPKFKISFGFEASDLLKSLGLHLPFSSEADLTEMVDSPEGKNLFVSSVFHKSFVEVNEEGTEAAAATAAVITLRSAPIAEDFVADHPFLFLIQEDMTGVVLFVGHVVNPLLAA

SEQ ID NO: 2649 - protein, 394 aa, Oryza sativa
  source: /note="subsp. japonica"
MPPKASKKDAAPAERPILGRFSSHLKIGIVGLPNVGKSTFFNIVTKLSIPAENFPFCTIDPNEARVYVPDERFDWLCQLYKPKSEVSAYLEINDIAGLVRGAHAGEGLGNAFLSHIRAVDGIFHVLRAFEDKEVTHIDDSVDPVRDLETIGEELRLKDIEFVQNKIDDLEKSMKRSNDKQLKLEHELCEKVKAHLEDGKDVRFGDWKSADIEILNTFQLLTAKPVVYLVNMSEKDYQRKKNKFLPKIHAWVQEHGGETIIPFSCAFERLLADMPPDEAAKYCAENQIASVIPKIIKTGFAAIHLIYFFTAGPDEVKCWQIRRQTKAPQAAGTIHTDFERGFICAEVMKFDDLKELGSESAVKAAGKYRQEGKTYVVQDGDIIFFKFNVSGGGKK

SEQ ID NO: 2650 - protein, 414 aa, Oryza sativa
  source: /note="subsp. japonica"
MESLTLRASPSTAAPLRRVPGRRHAAVSVRASAGAGEPDLSVRVNGLKMPNPFVIGSGPPGTNYTVMKRAFDEGWGGVIAKTVSLDAEKVINVTPRYARLRADPNGSTKSPIIGWQNIELISDRPLETMLNEFKQLKKEYPDRILIGSIMEEYNKAAWHELIERVEESGVDALEINFSCPHGMPERKMGAAVGQDCDLLEEVCGWINEKATVPVWAKMTPNITDITKPARISLKSGCEGVSAINTIMSVMGINLKTLRPEPCVEGYSTPGGYSARAVHPIALAKVMQIARMMKEEFADGQSLSAIGGVETGNDAAEFILLGADTVQVCTGVMMHGYGLVKKLCAELQDFMRQHNFSSIEDFRGASLPYFTTHTDLVHRQREAINQRKAIRKGLESDKDWTGDGFVKETESMVSN

SEQ ID NO: 2651 - protein, 411 aa, Oryza sativa
  source: /note="subsp. japonica"
MEKNCACPPPSKGNMITILSIDGGGVKGIIPAVILSFLESKLQELDGKDARIANYFDAIAGTSTGGLIAGMLAAPSLGNANQPCYAKDIVPFYLKHSPHIFPHRTGFFGWFFNILGIIKMAIGPKYDGKYLHRLINDLLGETRMKETLTNVVIPTFDVKCVKPIIFSTFKARRKPLKNACLADVCIGTSAAPTFLPAHYFETVDHTGASQSFNIIDGGMAANNPTLVTMGEITKQIKRKSEEFPKAEPLDYRKYLVISLGTGLPEHDIMFDARNVAKWGIFRWLVDKDTMPLLNMFFHASSDMADTLVADLFQAIGCSHQLLRIQDHNIPIGAISNDLSTKDHLQLLVKIGENLLKKPLSKEECEKNNIEPEPNLHGDHVTTYADMLTRFAKLLSDERKLRLHNMKLDAKP

SEQ ID NO: 2652 - protein, 475 aa, Oryza sativa
  source: /note="subsp. japonica"
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQLLYRRYSGNFLVNLIGKWKESEYSGHSVPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGF

SEQ ID NO: 2653 - protein, 514 aa, Oryza sativa
  source: /note="subsp. japonica"
MASISAASPVAGKAAAFAHKNELAAAAVAPSQQQLQRRVSGRRARSGRVRAVATPARAPRAPSSTGSVKSAMTMTEKILARASERASLEPGENVWVDVDVLMTHDVCGPGTIGIFKREFGEDAKVWDREKVVIIPDHYIFTSDERANRNVDILRDFCMEQNIKYFYDIKDLSNFKANPDYKGVCHVALAQEGHCRPGEVLLGTDSHTCNAGAFGQFATGIGNTDAGFVMGTGKALLKVPPTIRFVLDGEMPPYLLAKDLILQIIGEISVSGATYKSMEFVGSTVESLNMEERMTLCNMVIEAGGKNGVVPADQTTFNYLEGKTSVEYEPVYSDAQARFVSDYRFDVSKLEPVIAKPHSPDNRALARECKDVKIDRVYIGSCTGGKTEDFFAAAKVFLASGKKVKVPTFLVPATQKVWMDIYSIPVPGAGGKTCSQIFEEAGCDTPASPSCGACLGGPRDTYARMNEPMVCVSTTNRNFPGRMGHKEGQIYLASPFTAAASALTGYVTDPRDFLM

SEQ ID NO: 2654 - protein, 510 aa, Oryza sativa
  source: /note="subsp. japonica"
MSSGKGGGGGGKGGGGKKKEVKKETKLGMAYKKDDNFGEWYSEVVVNSEMIEYYDISGCYILRPWAMEIWELLKEFFDAEIKKLKLKPYYFPLFVTENVLQKEKDHIEGFAPEVAWVTKSGKSDLEAPIAIRPTSETVMYPYFSKWIRSHRDLPLRCNQWCNVVRWEFSNPTPFIRSREFLWQEGHTAFATKEEADEEVLQILELYRRIYEEFLAVPVSKGRKSEMEKFAGGLYTTSVEAFIPNTGRGVQGATSHCLGQNFAKMFDITFENDKGSRSMVWQNSWAYTTRSIGVMVMTHGDDKGLVLPPRVAPLQVIVIPVPYKDVDTTAIVNECKKTVETLEKAGIRADLDTRENYSPGWKYSHWEMKGVPLRIEIGPKDMANNQARVVRRDNGAKADIPTADLVEKVNGLLDEVQKNLFETAKQKRDACLKVVNTWDEFIVALNDKKLILAPWCDEEEVEKDVKARTKGDLGAAKTLCTPFEQPDLPEGTTCFASGKPAKKWSFWGRSY

SEQ ID NO: 2655 - protein, 534 aa, Oryza sativa
  source: /note="subsp. japonica"
MSLRPSERAEVRRSRYKVAVDADEGRRRREDNMVEIRKSRREESLLKKRRDGLPAAAAAAAAASPLLAHSSALQQKLEGLPAMVQAVQSDDSAVQLEATTQFRKLLSIERSPPIEEVINTGVVPRFIAFLQREDYPQLQFEAAWALTNIASGTSDNTKVVVESGAVPIFVKLLSSPSEDVREQAVWALGNVAGDSPKCRDLVLASGGLYPLLQQLNEHAKLSMLRNATWTLSNFCRGKPQPNFEQVKPALSALQRLIHSQDEEVLTDACWALSYLSDGTNDKIQAVIESGVFPRLVELLMHPSASVLIPALRTVGNIVTGDDMQTQCVIDHQALPCLLNLLTNNHKKSIKKEACWTISNITAGNREQIQAVINANIIAPLVHLLQTAEFDIKKEAAWAISNATSGGTHDQIKYLVAQGCIKPLCDLLVCPDPRIVTVCLEGLENILKVGEAEKNLGAGDVNSYAQMIDDAEGLEKIENLQSHDNTEIYEKAVKMLESYWLEEEDDAMPSGDNAQNGFNFGNQQPNVPSGGFNFG

SEQ ID NO: 2656 - protein, 558 aa, Oryza sativa
  source: /note="subsp. japonica"
MAAAAAATNGGFDVIVVGGGIMGSCAAYAAASSSASRCGGARVLLLERFDLLHHRGSSHGESRGIRATYPQARYPPMVRLAARLWGNAEAEAGYRVLTPTPHLDMGPRADPALRAAIQNGGAAEVVGASDDSAASWLWSAVFRLPEGWTAASSELGGVIKATKAVAMFQSLAAKNGAVLRDRTEVIDIAKQGDGSILVKTSSGEEFHGAKCIITVGAWASKLVKSVAGVDLPVQPLHTLICYWKARPGREHELTPESGFPTFASYGDTCIYSTPSMEFPGLIKVCAHGGAPCDPDRRDWCAGGDALADPVARWIDELMPGHVDTAGGPVIRQSCMYSMTPDEDFIIDFVGGEFGKDVVVGAGFSGHGFKMGPAVGRILAEMAMDGEAKTAAEAGVELGYFRIGRFEGNPEGNRAENKPPPGLPVRDGNGARRGRVGQERPRPRPLTLSPGPGPYWSPTQTGALQSCRERGQTRTVAAKTRWLIEEASVAEIWRRCRSRRRAMKTKAKQPATCDEGTTAGDTRQSCSSRRRSESAAAGDPRPRRKRSSRPGQRRSLARS

SEQ ID NO: 2657 - protein, 559 aa, Oryza sativa
  source: /note="subsp. japonica"
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRMYVTMDRYENDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRYAGMLQYDGELKLPSHYLVSPPEIERTSGEYLVKNGVRTFACSETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 2658 - protein, 586 aa, Oryza sativa
  source: /note="subsp. japonica"
MAMDDLAGSSSSSSAMDAVVADPSHGWQKVTYPKRHRKQGAAALPSAAAPDLGFLPNGGGKVNVFEAVDRNAEKRHRALLAARDAADPDAARIAAATASAYSDDDDDSDEAQATRPEGEVKKPKVKKPKKPKVTVAEAAALIDAENLAAHLVQISESYENQQDIQLMRFADYFGRSFASVSAAQFPWAKMFKESLVSKMVDIPLCHIPEPVRNTASDWINQRSPDALGDFVMWCIDSIMSELSGQAVGAKGSKKAAQQTPRAQVAIFVVLALTVRRKPEVLTNVLPKIMGNNKYLGQEKLPIIVWVIAQASQGDLVTGMFCWAHFLFPTLCAKPSGNPQTRDLVLQLLERILSAPKARGILLNGAVRKGERLIPPVTFDLFMRAAFPVSSARVKATERFEAAYPTIKELALAGPPGSKTVKQAAQQLLPLCVKAMQENNADLTGESAGVFIWCLTQNAESYKLWERLHPENVEASVVVLSTIVTKWSELSHKLSAESLKVTLKNLRTKNEAALEAATDSGKQASIKAADKYSKEILGRLSRGGACLKGSLLVITLAVAAGFVLSPNLEIPSDWDKLQAMVASHLSF

SEQ ID NO: 2659 - protein, 605 aa, Oryza sativa
  source: /note="subsp. japonica"
METHIGSVDGAAAAADNGAVGCPASAVGCPMTSARPAPVSAGEASLGRHLARRLVQVGVSDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKDCLCFIEVIAHKDDTSKELLEWGSRVSAANSRPPNPQ

SEQ ID NO: 2660 - protein, 587 aa, Oryza sativa
  source: /note="subsp. japonica"
MASMDEPLYPIAILIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKESDIVDWFVPVVKRLAAGEWFTARVSSCGLFHIAYPSAPDQLKAELRTIYGQLCQDDMPMVRRAAASNLGKFAATVEQNYLKTEVMSIFDDLTQDDQDSVRLLAVEGCAALGKLLEPQDCVAHILPVIVNFSQDKSWRVRYMVANQLYELCEAVGPEHSREQLVPAYVRLLRDNEAEVRIAAAGKVTKFCRILSPQLAIQHILPCVKELSSDSSQHVRSALASVIMGMAPVLGKEATIEQLLPIFLSLLKDEFPDVRLNIISKLDQVNQVIGIDLLSQSLLPAIVELAEDRHWRVRLAIIEYIPLLASQLGVGFFDDKLGALCMQWLEDKVFSIRDAAANNLKRLAEEFGPEWAMQHIIPQVLEKINNPHYLYRMTILQAISLLAPVMGAEITCQQLLPVVINSSKDRVPNIKFNVAKVLQALIPILDQSVVEKNVKPCLVELSEDPDVDVRYYANQALQACDQIMMSS

SEQ ID NO: 2661 - protein, 978 aa, Oryza sativa
  source: /note="subsp. japonica"
MAAAPPLAAGLRPAMAAAQAPVVAAAWGVGARRGAALSSSARCRALRLSRGGGGGRDGWVPPPVVGRMPPRTLSVRCAASNGRITQQEFTEMAWQSIVSSPEVAKESKHQIVETEHLMKSLLEQRNGLARRIFSKAGVDNTRLLDATEKFIQRQPKVLGEDPGSMLGRDLEALIQRARDFKKEYGDSFVSVEHLVLGFAEDKRFGRQLFKDFQITVQSLKTAIESIRGKQNVIDQDPEGKYEALDKYGKDLTAMARQGKLDPVIGRDDEIRRCIQILSRRTKNNPVLIGEPGVGKTAIAEGLAQRIVQGDVPQALTNRRLIALDMGALIAGAKYRGEFEDRLKAVLKEVTDSDGQTILFIDEIHTVVGAGATNGAMDAGNLLKPMLGRGELRCIGATTLDEYRKYIEKDPALERRFQQVYVDQPSVEDTISILRGLRERYELHHGVRISDSALVAAALLSDRYISGRFLPDKAIDLVDESAAKLKMEITSKPTALDEIDRAVIKLEMERLSLTNDTDKASRDRLSRIEAELSLLKEKQKDLTEQWEREKSVMTKIQSIKEEIDRVNVEIQQAEREYDLNRAAELKYGSLNALQRQLQTTEKELDEYQSSGKSMLREEVTQDDIAEIVSRWTGIPVSKLKQSDREKLLYLEEELHKRVVGQDPAVKAVSEAIQRSRAGLSDPNRPIASFMFMGPTGVGKTELAKALAAFMFNTEEAVVRIDMSEYMEKHSVSRLIGAPPGYVGYEEGGQLTEAVRRRPYSIILFDEIEKAHGDVFNVFLQILDDGRVTDSQGRKVSFTNSIIIMTSNVGSQFILNMDEEGGSTDSAYENIKKRVMDAARSVFRPEFMNRIDEYIVFKPLEREQINSIVKLQLARVQKRIADRKIKLEVSPGAVEFLGSLGYDPNYGARPVKRVIQQYVENELAKGILRGDFKDEDSILVDTQVTVPSNGQLPQQKLVFHKMSEESAPAAAEDEKFLPAV

SEQ ID NO: 2662 - protein, 101 aa, Oryza sativa
  source: /note="subsp. japonica"
MARGGGGGQREGNALKTAVVVTGGLVLAWFTMESAFKPFLDRLRGALTRNTDPARDPDEENSAAPADRAVEEPAAAAAPVEEGEGKGVELEEKGEGAAMTE

SEQ ID NO: 2663 - protein, 116 aa, Oryza sativa
  source: /note="subsp. japonica"
MARAQLVLVALVAALLLAAPHAAVAITCGQVNSAVGPCLTYARGGAGPSAACCSGVRSLKAAASTTADRRTACNCLKNAARGIKGLNAGNAASIPSKCGVSVPYTISASIDCSRVS

SEQ ID NO: 2664 - protein, 123 aa, Oryza sativa; identical to SEQ ID NO: 627
  source: /note="subsp. japonica"

SEQ ID NO: 2665 - protein, 131 aa, Oryza sativa
  source: /note="subsp. japonica"
MARGVAAAAGGKGGAGKKKGSVTFVIDCAKPVDDKIMEIASLEKFLQERIKVAGGKAGNLGESVTVSRDKTKVTVTSDGPFSKRYLKYLTKKYLKKHNVRDWLRVIASNKDRNVYELRYFNIAENEGEEED

SEQ ID NO: 2666 - protein, 148 aa, Oryza sativa
  source: /note="subsp. japonica"
MADQHRGVIGGGGYGDRGGQEQQEKQRFMMTALKTVTAATAGGSMLVLSGLILAGTVIALTVATPVLVIFSPVLVPAAIALALMAAGFVTSGGLGVAALSVFSWMYKYLTGKHPPGADQLDHAKARLASKARDIKEAAQHRIDQAQAS

SEQ ID NO: 2667 - protein, 135 aa, Oryza sativa
  source: /note="subsp. japonica"
NALLTPHWTVNAHIVMYVTAGQGRIQVVDHRGRTVFDGELRQQQILLIPQNFAVAVKARQEGFSWVSFKTSHNAIDSQIAGKRSILRALPVDVVAKAYLLSREESRSLKFNRGDEMAVFSPRLHQQLYAEWQNSK

SEQ ID NO: 2668 - protein, 150 aa, Oryza sativa
  source: /note="subsp. japonica"
MSKRKTREPKEENVTLGPTVREGEYVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 2669 - protein, 171 aa, Oryza sativa; identical to SEQ ID NO: 500
  source: /note="subsp. japonica"

SEQ ID NO: 2670 - protein, 172 aa, Oryza sativa
  source: /note="subsp. japonica"
MSNTRVFFDMTVGGAPAGRIVMELYAKDVPRTAENFRALCTGEKGVGKSGKPLHYKGSTFHRVIPEFMCQGGDFTRGNGTGGESIYGEKFADEVFKFKHDSPGILSMANAGPNTNGSQFFICTVPCSWLDGKHVVFGRVVEGMDVVKAIEKVGSRGGSTAKPVVIADCGQLS

SEQ ID NO: 2671 - protein, 190 aa, Oryza sativa
  source: /note="subsp. japonica"
MKTILASETMEIPEGVTVQVAAKVVTVEGPRGKLTRNFKHLNLDFQLLEGGRKLQVDAWFGTRRTMAAIRTAISHVQNLITGVTKGYRYKMRFVYAHFPINASITNSNTAIEIRNFLGEKKVRKVDMLEGVTILRSEKVKDELVLDGNDIELVSRSAALINQKCHVKNKDIRKFLDGIYVSDKGTITEDA

SEQ ID NO: 2672 - protein, 199 aa, Oryza sativa
  source: /note="subsp. japonica"
MAEVELPQQEVKLFSRWSFEDVQVNDISLADYLAVNPTKHATYLPHTAGRYSAKRFRKAQCPIVERLTNSLMMHGRNNGKKIMAVRIVKHAMEIIHLLTDANPIQVIVDAIINSGPREDATRIGSAGAVRRQAVDISPLRRVNQAIYLLTTGARESAFRNIKTIAECLADELINAAKGSSNSYAIKKKDEIERVAKANR

SEQ ID NO: 2673 - protein, 216 aa, Oryza sativa
  source: /note="subsp. japonica"
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLAETDSKPEDKTIKINNKTDQGADKPAASGSACCGS

SEQ ID NO: 2674 - protein, 240 aa, Oryza sativa
  source: /note="subsp. japonica"
MAAPFALVSRVSPAARLPIRAAWRRARPTVGLPSSGRARQLAVASAAQENRDNTAVDVHVNQDGGNQQGNAVQRRPRRSSALDGISPFGLVDPMSPMRTMRQMLDTMDRIFDDVALGFPATPRRSLATGEVRMPWDVMEDDKEVRMRFDMPGLSREEVKVMVEDDALVIRGEHKKEEGEGAEGSGDGWWKERSVSSYDMRLALPDECDKSKVRAELKNGVLLVTVPKTEVERKVIDVQVQ

SEQ ID NO: 2675 - protein, 264 aa, Oryza sativa; identical to SEQ ID NO: 611
  source: /note="subsp. japonica"

SEQ ID NO: 2676 - protein, 265 aa, Oryza sativa
  source: /note="subsp. japonica"
MAAGPRGRLLLVALVSAAAVVAGALLPGCAAAAAAGEKVPLALYYETLCPYCSRFIVNHLAGIFEDGIVDAVDLRLVPYGNAHVVGANNTISCQHGSEECFLNTVEACAIDAWPDLRVHFRFIYCVEDLVVNHKQREWESCFGKLNLDPKPVTDCYKGERGHQLSLKYGRQTDALQPPHKYVPWVVVDGQPLYEDYENFEAYICKAYKGHPPKVCEGLARPPTPTVLEVAEAVNRVSYYDSGDIRLKPDEDGHAKIKKVVPDDDD

SEQ ID NO: 2677 - protein, 265 aa, Oryza sativa
  source: /note="subsp. japonica"
MARGLKKHLKRLNAPKHWMLDKLGGAFAPKPSSGPHKSRECLPLILIIRNRLKYALTYREVISILMQRHVLVDGKVRTDKTYPAGFMDVISIPKTGENYRLLYDTKGRFRLQSVKDEDAKFKLCKVRSVQFGQKGIPYLNTYDGRTIRYPDPIIKANDTIKIDLETNKIVDFIKFDVGNVVMVTGGRNTGRVGVIKNREKHKGSFETIHVEDALGHQFATRLGNVFTIGKGNKPWVSLPKGKGIKLSIIEEQRKRDAAAQAAANA

SEQ ID NO: 2678 - protein, 310 aa, Oryza sativa
  source: /note="subsp. japonica"
PPLHVATATSRSHRSLKRLRALHRESSVFRSFGPRQAEAEGCRGQRRPRPGATATAPAPKPRARRGRLTGGSGVEAKDSLTIVALQSPVTVERPVRGDLEEHVPKPYLARALAAPDIYHPDGTTTDDHEHHHLSVLQQHVAFFDRDDNGIIYPWETYEGCRALGFNMIMSFLIALVVNVSMSYPTLPGWLPSPFFPIYIHNIHRSKHGSDSGTYDNEGRFMPVNFENIFSKYARTSPDRLTYREVWQMTEGNREVLDLFGWFAAKLEWTILYVLARDEEGYLAREAIRRMYDGSLFEYVAMQREQHAKMS

SEQ ID NO: 2679 - protein, 354 aa, Oryza sativa
  source: /note="subsp. japonica"
MCVEELEGAERLDFGGVAELETTPADFEMEKVCENTVSLDFKQARSSSFVPVIRSGDWSDIGGRDYMEDAHVCISDLANNFGHNSVDDEIISFYGVFDGHGGKDAAHYVRDNLPRVIVEDADFPLELEKVVRRSFVQTDSQFAERCSHQNALSSGTTALTAMIFGRSLLVANAGDCRAVLSRRGTAIEMSKDHRTCCLNERKRIESLGGYVDDGYLNGQLAVTRALGDWHLEGLKEVGEPGGPLSAEPELKMITLTKEDEFLIIGSDGIWDFFSNQNAVDFTRKRLQEHNDLRLCCKQIVEEAIRRGASDNLTAVMVSFHQEAPPQLRVNRTGRVERSISAEGLHSLRVLLEGQ

SEQ ID NO: 2680 - protein, 488 aa, Oryza sativa
  source: /note="subsp. japonica"
MSLSTVNHAAAAAAAAAGPGKSFSAAAPAAPSVRLPRTRAPAAAAVSAAAVGADRAADRVSALSQVSGVLGSQWGDEGKGKLVDVLAPRFDIVARCQGGANAGHTIYNSEGKKFALHLVPSGILHEGTLCVVGNGAVIHVPGFFNEIDGLESNGVNCNGRILVSDRAHLLFDLHQAVDGLREAELANSFIGTTKRGIGPCYSSKVTRNGLRVCDLRHMDTFGDKLDVLFKDATSRFEGFEYSKSMLREEVERYKRFAERLEPFIADTVHLLNESIQQKKKILVEGGQATMLDIDFGTYPFVTSSSPSAGGICTGLGIAPRCIGDLIGVVKAYTTRVGSGPFPTELFGEEGDLLRKSGMEFGTTTGRPRRCGWLDIVALKYCCEINGFSSLNLTKLDVLSGLPEVKLGVSYNQPDGQKLQSFPGDLDTLEQVQVKYEVLPGWQSDISSVRSYSELPLAAQRYVERIEELVGVPVHYIGVGPGRDALIYK

SEQ ID NO: 2681 - protein, 534 aa, Oryza sativa
  source: /note="subsp. japonica"
MLRAALLRSGSGLRRPPMAAPLSTAAAASWLSDSASSPPRVRLLIGGEFVESRADEHVDVTNPATQEVVSRIPLTTADEFRAAVDAARTAFPGWRNTPVTTRQRIMLKYQELIRANMDKLAENITTEQGKTLKDAWGDVFRGLEVVEHACGMGTLQMGEYVSNVSNGIDTFSIREPLGVCAGICPFNFPAMIPLWMFPIAVTCGNTFVLKPSEKDPGAAMMLAELAMEAGLPKGVLNIVHGTHDVVNNICDDEDIKAVSFVGSNIAGMHIYSRASAKGKRVQSNMGAKNHAIILPDADRDATLNALIAAGFGAAGQRCMALSTAVFVGGSEPWEDELVKRASSLVVNSGMASDADLGPVISKQAKERICKLIQSGADNGARVLLDGRDIVVPNFENGNFVGPTLLADVKSEMECYKEEIFGPVLLLMKAESLDDAIQIVNRNKYGNGASIFTTSGVSARKFQTDIEAGQVGINVPIPVPLPFFSFTGSKASFAGDLNFYGKAGVQFFTQIKTVTQQWKESPAQRVSLSMPTSQK

SEQ ID NO: 2682 - protein, 577 aa, Oryza sativa
  source: /note="subsp. japonica"
MYRAAASLASKARQAGSSARQIGSRLALHRNYAAKDIKFGVEARALMLRGVEELADAVKVTMGPKGRTVVIEQSFGAPKVTKDGVTVAKSIEFSNRVKNVGASLVKQVANATNDTAGDGTTCATVLTKAIFAEGCKSVAAGMNAMDLRRGISMAVDEVVTNLKGMARMISTSEEIAQVGTISANGEREIGELIAKAMEKVGKEGVITITDGNTLYNELEVVEGMKLDRGYISPYFITNQKNQKCELDDPLILIHDKKVSNLHAVVKVLELALKKQRPLLIVAEDVESEALGTLIINKLRAGIKVCAVKAPGFGESRKANLQDLAILTGGEVITEELGMNLENFEPQMLGTCKKVTVSKDDTVILDGAGDKKAIEERAEQLRSAIELSTSDYDKEKLQERLAKLSGGVAVLKIGGASEAEVGEKKDRVTDALNATKAAVEEGIVPGGGVALLYASKDLDKLQTANFDQKIGVQIIQNALKTPVHTIASNAGVEGSVIIGKLLEQDNTDLGYDAAKGEYVDMVKSGIIDPLKVIRTALVDAASVSSLMTTTESIIVEIPKEEEAAAAAPAMGGMGGMGF

SEQ ID NO: 2683 - protein, 584 aa, Oryza sativa
  source: /note="subsp. japonica"
MATMPSTCASSSSLFLLLRRDRRSSRSASLPGPARRLGVVRASAKEIAFDQGSRSSLQAGVEKLAAAVAVTLGPRGRNVVLDEFGSPKVVNDGVTIARAIELADPMENAGAALIREVASKTNDSAGDGTTTASVLAREIIKLGLLSVTSGANPVSIKKGIDKTVHSLVEELEKKSRPVKGSGDIKAVAAISAGNDDFVGTMIAEAIDKVGPDGVLSIESSSSFETTVEVEEGMEIDRGYISPQFVTNPEKSLVEFENARILVTDQKISSIKEIIPLLEQTTQLRAPLLIIAEDVAGEALATLVVNKLRGILNVAAIKAPGFGERRKALLQDIAIVTGAEFQAKDLGLLVESTTVEQLGIARKVTISQSSTTIIADVATKDEIQARIAQLKRELSQTDSAYDSEKLAERIAKLSGGVAVIKVGAATETELEDRKLRIEDAKNATFAAIEEGIVPGGGAAYVHLSKFVPAIKEKLDDPEERLGADIIQKALVAPAALIAHNAGVEGEVIVEKIKESEWEVGYNAMADRHENLVQAGVIDPAKVTRCALQNAASVAGMVLTTQAIVVEKPKKKASAASGAPEGSLAM

SEQ ID NO: 2684 - protein, 537 aa, Oryza sativa
  source: /note="subsp. japonica"
MVGGRALLPLLLLSALLVQIRASDPLFYEPFDESFEGRWVLSGKDDYKGVWKHEKSDGHEDYGLLVSEKAKKYAIIKELDEPVTLKDGTVVLQFEVRLQNGLECGGAYLKYIRPQDAAWDAKEFDNETPYTIMFGPDKCGSTNKVHFILKHKNPKTGKYVEHHLKFPPSVPYDKLSHVYTAILKPDNEVRILVDGEEKKKANFLSADDFEPSLIPSKTIPDPDDKKPEDWDERAKIPDPDAVKPDDWDEDAPMEIEDEEATKPEGWLDDEPEEIDDPEANKPEDWDDEEDGEWEAPKIDNPKCEEAPGCGEWKRPMKQNPAYKGKWHAPLIDNPNYKGIWKPQEIPNPEYFELDKPDSDPIAAIGIEIWTMQDGILFDNILIADDEKVATSILEKSWKPKYEVEKEKEKAEEAAAAAGDGLSEFQKKIFDVLYKLADIPFLEPYKTKIIDVIEKGEKQPNITIGILVSIVVVFVTVLFRILFGGKKPAAPVKPVAEVKKPKSTESEAAGSSGGKEDEKEEEEKDGAAAPRRRSRRET

SEQ ID NO: 2685 - protein, 613 aa, Oryza sativa
  source: /note="subsp. japonica"
MAAPSQTTATTTHHRVLLPSHHHHRAVPPSLLRLPLRAARRGRLSAAAAAAAPAASTAAPSEPAAGAVPGKPTVLVAEKLGAAGLELLRGFANVDCSYGLSPEELRAKIPLCDALIVRSGTKVGRDVFEASGGRLRVVGRAGVGIDNVDLAAATEHGCLVVNAPTANTVAAAEHGIALLTAMSRNIAQADASLKAGKWQRNKYVGVSLVGKTIAILGFGKVGSEVARRAKGLGMHVIAHDPYASADRAHAIGVELVSMEDALTTADFISLHMPLTPATNKMLNDETFAKMKKGVRIINVARGGVIDEDALVRALDSGIVAQAALDVFTKEPPAPDSKLVLHENVTVTPHLGASTVEAQEGVAIEIAEAVIGALKGELAASAVNAPMVPAEVLSELAPYVVLAEKLGRLAVQLVAGGGGIKSVKVTYASARAPDDLDTRLLRAMITKGLIEPISSVFVNLVNADFTAKQRGVRITEERILLDGSPETPIDYIQVHIAHVESKFPSAISESGEITVEGKVKDGIPHLTKVGSFQVDVSLEGSLILCRQVDQPGMIGAVGSVLGEENVNVSFMSVGRIAPRKHAVMAIGVDEEPKKSTLTKIGEIPAIEEFVFLKL

SEQ ID NO: 2686 - protein, 622 aa, Oryza sativa
  source: /note="subsp. japonica"
MGSVAMDSDYGVPRELSALQKARALYRPDLPPCLQGTTVKVEYGDAAIAADVAGAHVISHAFPHTYGQPLAHFLRKTAAVPDATVITEHPVVRVGVVFSGRQSPGGHNVIWGLHDAIKAHNANSKLIGFLGGTDGLFAQKTLEISDEVLSSYKNQGGYDLLGRTRDQIRTTEQVNAAMTACQALKLDALVIIGGVTSNTDAAQLAETFAESKCSTKVVGVPVTLNGDLKNQFVETTVGFDTICKVNSQLISNVCTDALSAEKYYYFVRLMGRKASHVALECALQSHPNMVILGEEVAASKLTIFDITKQICDAVQARAEKDKNHGVVLIPEGLVESIPELYALLQEIHGLHDKGVSVENISSHLSPWASALFEFLPPFIRKQLLLHPESDDSAQLSQIETEKLLAQLVEAEMNKRLKEGTYKGKKFNAICHFFGYQARGALPSKFDCDYAYVLGHVCYHILAAGLNGYMATVTNLRSPVNKWKCGAAPITSMMTVKRWSRGPAASQIGKPAVHMASIDLKGKPYELLRQNSSSFLMEDIYRNPGPLQFEGPGGETKPISLCVEDRDYMGRIKQLQEYLEKVKSIVKPGCSQDVLKAALSAMASVTEMLTIMSSPSFSGQATI

SEQ ID NO: 2687 - protein, 810 aa, Oryza sativa
  source: /note="subsp. japonica"
MRKWALSSALLLLLLTTLPDPAKKLQVNADDSTDELVDPPKVEEKIGGVPHGLSTDSEVVQREAESISRKTLRSSAEKFEFQAEVSRLMDIIINSLYSNKDIFLRELISNASDALDKIRFLALTDKEVLGEGDTAKLEIQIKLDKEKKILSIRDRGIGMTKEDLIKNLGTIAKSGTSAFVEKMQTGGDLNLIGQFGVGFYSVYLVADYVEVISKHNDDKQHVWESKADGSFAISEDTWNEPLGRGTEIRLHLRDEAKEYVEEDKLKDLVKKYSEFINFPIYLWATKEVDVEVPADEDESSESSEEEESSPESTEEEETEESEEKKPKTKTVKETTTEWELLNDVKAIWLRSPKEVTEEEYTKFYHSLAKDFGDDKPLSWSHFTAEGDVEFKALLFVPPKAPHDLYESYYNSNKSNLKLYVRRVFISDEFDELLPKYLSFLKGLVDSDTLPLNVSREMLQQHSSLKTIKKKLIRKALDMIRKLAEEDPDEYSNKDKTDEEKSAMEEKKGQYAKFWNEFGKSVKLGIIEDATNRNRLAKLLRFESTKSEGKLASLDEYISRMKPGQKDIFYITGSSKEQLEKSPFLERLTKKNYEVIYFTDPVDEYLMQYLMDYEDKKFQNVSKEGLKLGKDSKLKDLKESFKELTDWWKKALDTESVDSVKISNRLSDTPCVVVTSKYGWSANMEKIMQSQTLSDASKQAYMRGKRVLEINPRHPIIKELRDKVAQDSESESLKQTAKLVYQTALMESGFNLPDPKDFASSIYRSVQKSLDLSPDAAVEEEEEVEEAEVEEKESSNIKEEAEPSSYDKDEL

SEQ ID NO: 2688 - protein, 955 aa, Oryza sativa
  source: /note="subsp. japonica"
MSVSMKDLDPAFRGAGQKEGLEIWRIENFKPVPIPASSYGKFFMGDSYIILKTTALKNGSLRHDIHYWIGKDTSQDESGTAAILTVELDAALGGRAVQYREIQGNETDKFLSYFRPCIMPQPGGVASGFKHVEVNEQEHETRLYVCTGNRVVHVKEVPFARSSLNHDDIFILDTKSKIFQFNGSNSSIQERAKALEVVQYIKDTFHEGKCEVAAVEDGRLMADAEAGEFWGFFGGFAPLPRRAPVEDNEKYEETVFKLLCFNQGKLEPINYESLLHELLKTNKCYLLDCGVELFVWMGRTTSLQERKSASEAAEKLLSDDNRTKTHVIKVIEGFETVMFKSKFKEWPQTPDLKLSSEDGRGKVAALLKRQGLNVKGLMKAAPAKEEPQAYIDCTGSLQVWRINDKDKILLPSADQSKFYTGDCYIFQYMYPGDDKEECLIGSWFGKKSIEEDRVTAISLASKMVESAKFQAVQTRLYEGKEPIQFFVIFQSFQVFKGGLSSGYKKFIAENGIDDDTYLEDGLALFRIQGSGPENMQAIQVDAAASSLNSSYSYILHDGNTVFTWTGNLTTSLDQEVVERQLDIIKPNSQSRSQKEGSETDQFWSLLGGKSEYPSQKIGRANESDPHLFSCILPKGNLKIKEIYHFTQDDLMTEDVFILDCHSDIFVWVGQQVDVKVRLQALDIGEKFVKLDFLMENLSSDTPIFVIMEGSEPTFFTRFFTWDSAKSLMHGNSYQRKLSIVKGGGSPALDKPKRRTPTYSGRSTVQDKSQRSRSMSFSPERVRVRGRSPAFTALAANFESANSRNLSTPPPVVKKLYPKSATPDSSSAPSKSSATASLTGSFDRPKSVKDGSELEKPKQEEDAKEGINTMTSRVESLTINEDVKENEPEDDEGLPVYPYDRLITTAADPVTEIDVTRRETYLSSAEFKDKFGMTKEAFSKLPKWKQNRMKIALQLF

SEQ ID NO: 2689 - protein, 1790 aa, Oryza sativa
  source: /note="subsp. japonica"
MEMALRPQSLLCPRSRLKVVIRPASSASGGGLAQYFLMTRRYTGSRIVRCMVSSSDCPNRKAKRTISLHTEVASSRGYAPRIAAESSIQEREHINSDEETFDTYNRLLRNESTEWKKLDTTEVDLSQDVSSSSMRKVDATDEAKLDILEDDLPRNLLNGVTMGEVDMLDEAGAEDDVFEVDLSALHNSTVGKMDAVNEVGTENDLFEVDLSALHSAAVGKVDVVDGAKAKEDLFEMDSLALHSVTMGKVDAINAAGAEGDKFEVDLSALASNNSMIEAVNVMDEAKAIEDTLEVDLSGNATSSSTYGEVKFEVDSLGNTSSTVMYGPADGAYEPRSDEVTFKVDSSENASNNVMYGRADVVDESWADEGIFEVDFFTNASSGAEYGKVDVVDEAKTDDFTFEIDSLEKDSNNKMHGKAHMVDEAWDDEAIFEVDLFGNASSIPIYGEVNVLDEARADDGKFEVDLLGNTSSNSTHEEVDVVDEAQTGEATFEVDLLGNALSSAIYKEVPVMGGAQDDEVDVDFSINASITETEKEADAVDEARVEDETFDMDLVGKQISIDSMNDDVVEEGTKHHRYPMLSSAFIEVKTIHETPVSLKPELMSVVMDQEQDKPISSVYQQEGSIFNLHAENQSTVDFHEREQMAITFDKQKESVAKLSKEDQQTAGLPEQNMSFDGVHRKSQSIIGLPFQHQSIVSSPEKYRSIVGFHGQNQSIISSHKQDKSIVGVPKKIQSIVGSTKHDDSIVGFRKQDRSIVSVPEQKQSIVGFHKQDLSIVAVSEQNLSIVAIPRESQSKQISIVRRHDPLHLKEVETKDRDGISKKSGGDDDLPHMLFEEELSQVEDVARAIAYKKQHEVDVISLTPDIQESPQDNIDPQELRRMLQELADQNCSMGNKLFVFPEAVKANSTIDVYLNRNLSALANEPDVHIKGAFNSWRWRPFTERLHKSELSGDWWSCKLHIPKEAYRLDFVFFNGRLVYDNNDSNDFVLQVESTMDEDSFEEFLVEEKKRELERVATEEAERRRHAEEQQRMGEQRAAEQAAREQAKKEIELKKNKLQNLLSSARTHVDNLWHIEPSTYRQGDTVRLYYNRNSRPLMHSTEIWMHGGCNSWTDGLSIVERLVECDDENGDWWYANVHIPEKAFVLDWVFADGPPGNARNYDNNGRQDFHAILPNAMTNEEYWVEEENCIYTRLLHEIREREEAIKIKVEKRAKMKSEMKEKTMRMFLLSQKHIVYTEPLEIRAGTTVDVLYNPSNTVLNGKPEVWFRWSFNRWMHPSGVLPPKKMVKTEDGCHLKATVSVPSDAYMMDFVFSESEEGGIYDNRNGTDYHIPVSGSNAKEPPIHIVHIAVEMAPIAKVGGLADVVTSLSRAIQELGHHVEVILPKYNFMNQSNVKNLHVRQSFSLGGTEIKVWFGLVEDLSVYFLEPQNGMFGGGWVYGGNDAGRFGLFCQSALEFLLQSGSSPHIIHCHDWSSAPVAWLYKEHYAESRLATARIIFTIHNLEFGAHFIGKAMTYCDKATTVSHTYSKEVAGHGAIAPHRGKFYGILNGIDPDIWDPYTDNFIPMHYTSENVVEGKNAAKRALQQRFGLQQTDVPIVGIITRLTAQKGIHLIKHALHRTLERNGQVVLLGSAPDPRIQSDFCRLADSLHGENHGRVRLCLTYDEPLSHLIYAGSDFILVPSIFEPCGLTQLVAMRYGSIPIVRKTGGLYDTVFDVDHDKDRARVLGLEPNGFSFDGADCNGVDYALNRQRAISSWFEARGWFHSLCKRVMEQDWSWNRPALDYIELYHSAHKF

SEQ ID NO: 2690 - protein, 96 aa, Oryza sativa; identical to SEQ ID NO: 530
  source: /note="subsp. japonica"

SEQ ID NO: 2691 - protein, 139 aa, Oryza sativa; identical to SEQ ID NO: 622
  source: /note="subsp. japonica"

SEQ ID NO: 2692 - protein, 130 aa, Oryza sativa
  source: /note="subsp. japonica"
MVRVSVLNDALKTMYNAEKRGKRQVLIRPSSKVIIKFLIVMQKHGYIGEFEFVDDHRSGKIVVELNGRLNKCGVISPRFDVGVKEIESWTARLLPSRQFGYIVLTTSAGIMDHEEARRKNVGGKVLGFFY

SEQ ID NO: 2693 - protein, 172 aa, Oryza sativa
  source: /note="subsp. japonica"
MADRDRAGQYYQQQRGQVGETVKGILPEKAPSASQALTVATLFPLGGLLLVLSGLALAASVVGLAVATPVFLIFSPVLVPAALLIGLAVAGFLTSGALGLGGLSSLTFLANTARQAFQRTPDYVEQARRRMAEAAAHAGHKTAQAGHAIQGRADQAGTGAGAGGGAGTKTSS

SEQ ID NO: 2694 - protein, 150 aa, Oryza sativa
  source: /note="subsp. japonica"
MKRNPRVTSSRRKCRKAHFTAPSSVRRVLMSAALSTELRHKYNVRSIPIRKDDEVQVVRGSYKGREGKVVQVYRRRWVIHVERITREKVNGSTVNVGIHPSKVVVTKLKLDKDRKAILDRKASGRAADKAKGKFTAEDVAAAGASLQEID

SEQ ID NO: 2695 - protein, 166 aa, Oryza sativa
  source: /note="subsp. japonica"
MPPKLDPTQVVDVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIARIMRNRSMAKEMAGTVKEILGTCVSVGCTVDGKDPKDLQQEISDGEVEIPSA

SEQ ID NO: 2696 - protein, 160 aa, Oryza sativa
  source: /note="subsp. japonica"
MSDSEEHHFESKADAGASKTYPQQAGTIRKNGYIVIKNRPCKVVEVSTSKTGKHGHAKCHFVAIDIFTAKKLEDIVPSSHNCDVPHVNRTEYQLIDISEDGFVSLLTENGNTKDDLRLPTDDNLLSQIKDGFGEGKDLVVTVMSAMGEEQICALKDIGPK

SEQ ID NO: 2697 - protein, 165 aa, Oryza sativa
  source: /note="subsp. japonica"
MAGGGRADDERRIGVAMDYSASSKRALDWAIANLLRRGDHLVVLHVLHHGGEEAKHALWGKSGSPLIPLSEFRDPTAMQQYGVHCDAEVLDMLDTAARQLELTVVAKLYWGDAREKLCDAVEEQKIDTLVMGSRGLGSIQRILLGSVTNYVLSNASCPVTVVKGK

SEQ ID NO: 2698 - protein, 182 aa, Oryza sativa
  source: /note="subsp. japonica"
MASEKKQSNPMREIKVQKLVLNISVGESGDRLTRASKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANTS

SEQ ID NO: 2699 - protein, 178 aa, Oryza sativa
  source: /note="subsp. japonica"
MGAFRFHQYQVVGRGLPTPTDEHPKIYRMKLWATNEVRAKSKFWYFLRKLKKVKKSNGQILAINEIFEKNPTTIKNYGIWLRYQSRTGYHNMYKEYRDTTLNGAVEQMYTEMASRHRVRFPCIQIIKTATVHFKLCKRDNTKQFHKSDIKFPLVYRKVRPPTRKLKTTFKASRPNLFM

SEQ ID NO: 2700 - protein, 192 aa, Oryza sativa
  source: /note="subsp. japonica"
MYTARKKIQKEKGLEPSEFEDSVAQAFFDLENGNQELKSELKDLYINNAVQMDIAGNRKAVVIHVPYRLRKAFKKIHVRLVRELEKKFSGKDVVIVATRRIVRPPKKGSAVQRPRTRTLTAVHDGILEDVVYPAEIVGKRIRYRLDGAKVIKIFLDPKERNNTEYKLETFSAVYRRLCGKDVAFEYPMTETA

SEQ ID NO: 2701 - protein, 195 aa, Oryza sativa
  source: /note="subsp. japonica"
MVHVSFYRNYGKTFKKPRRPYEKERLDAELKLVGEYGLRCKRELWRVQYALSRIRNNARHLLTLDEKNPRRIFEGEALLRRMNRYGLLADGQNKLDYVLALTVENFLARRLQTLVFKAGMAKSIHHARVLIRQRHIRVGRQIVNIPSFMVRVESEKHIDFSLTSPFGGGPPGRVKRKNQKKASGGGGDGEEEDEE

SEQ ID NO: 2702 - protein, 219 aa, Oryza sativa
  source: /note="subsp. japonica"
MAPTSKLSQGIKRASRSHTYHRRGLWAIKAKNGGTFPKAGKPAAAAEPKFYPADDVKPRAPSTRKANPTKLRSTITPGTVLILLAGRYMGKRVVFLKQLKSGLLLITGPFKINGVPIRRVNQAYVIATSTKVDISGVKVDKFDDKYFARDKKAKAKKTEGELFETEKEATKNLPDFKKDDQKAVDAELIKAIEVVPDLKSYLGARFSLRDGDKPHEMTF

SEQ ID NO: 2703 - protein, 257 aa, Oryza sativa; identical to SEQ ID NO: 649
  source: /note="subsp. japonica"

SEQ ID NO: 2704 - protein, 261 aa, Oryza sativa; identical to SEQ ID NO: 612
  source: /note="subsp. japonica"

SEQ ID NO: 2705 - protein, 261 aa, Oryza sativa
  source: /note="subsp. japonica"
MAACCSSLATAVSSSSAKPLAGIPPAAPHSLSLPRAPAARPLRLSASSSRSARASSFVARAGGVDDAPLVGNKAPDFDAEAVFDQEFINVKLSDYIGKKYVILFFYPLDFTFVCPTEITAFSDRYDEFEKLNTEILGVSIDSVFSHLAWVQTDRKSGGLGDLKYPLISDVTKSISKSFGVLIPDQGIALRGLFIIDKEGVIQHSTINNLAIGRSVDETMRTLQALQYVQDNPDEVCPAGWKPGDKSMKPDPKGSKEYFAAI

SEQ ID NO: 2706 - protein, 270 aa, Oryza sativa
  source: /note="subsp. japonica"
MFRNQYDTDVTTWSPAGRLFQVEYAMEAVKQGSACVGLRSRTHAVLAAANKAASELSSHQRKVFRVADHAGVALAGLTADGRVLSRFLRSECINHAFVYDAPLPVSRLALRLADKAQVCTQRSWKRPYGVGLLVAGLDESGAHLYYNCPSGNYFEYQAFAIGSRSQAAKTFLERRFEGYNDYTPEQLIKDALSAIKETLQGEKLTSSNCTVAIVGRKDDGTVEPFEMIDVKRIQEIIDSMEAAEEAPAAEAESSSMQEEDKGTDAAPMDI

SEQ ID NO: 2707 - protein, 290 aa, Oryza sativa
  source: /note="subsp. japonica"
MGKDEVMESGGAAGEFAAKDYTDPPPAPLIDAAELGSWSLYRAVIAEFIATLLFLYITVATVIGYKHQTDASASGADAACGGVGVLGIAWAFGGMIFILVYCTAGISGGHINPAVTFGLFLARKVSLVRAILYIVAQCLGAICGVGLVKAFQSAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 2708 - protein, 360 aa, Oryza sativa
  source: /note="subsp. japonica"
CVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFKLF

SEQ ID NO: 2709 - protein, 379 aa, Oryza sativa
  source: /note="subsp. japonica"
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 2710 - protein, 364 aa, Oryza sativa
  source: /note="subsp. japonica"
MAGTVTVPSASVPSTPLLKDELDIVIPTIRNLDFLEMWRPFFQPYHLIIVQDGDPTKTIRVPEGFDYELYNRNDINRILGPKASCISFKDSACRCFGYMVSKKKYVFTIDDDCFVAKDPSGKDINALEQHIKNLLSPSTPFFFNTLYDPYREGADFVRGYPFSLREGAKTAVSHGLWLNIPDYDAPTQMVKPRERNSRYVDAVMTVPKGTLFPMCGMNLAFDRDLIGPAMYFGLMGDGQPIGRYDDMWAGWCMKVICDHLSLGVKTGLPYIWHSKASNPFVNLKKEYKGIFWQEDIIPFFQNATIPKECDTVQKCYLSLAEQVREKLGKIDPYFVKLADAMVTWIEAWDELNPSTAAVENGKAK

SEQ ID NO: 2711 - protein, 396 aa, Oryza sativa
  source: /note="subsp. japonica"
MALRPNDVTLRLTPPLAAAARRNRRAAAGGVRVYAVASGAVSTKVENKKPFAPPREVHVQVTHSMPPQKIEIFKSLDDWARDNILSHLKPVEKCWQPQDFLPDPASDGFHDEVKELRERAKEIPDDYFVCLVGDMITEEALPTYQTMLNTLDGVRDETGASPTAWAVWTRAWTAEENRHGDLLNKYLYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVLAFADMMKKKISMPAHLMFDGEDDKLFEHFSMVAQRLGVYTAKDYADILEFLVSRWKISDLTGLSSEGNKAQDYLCTLAARIRRLDERAQSRAKKAGTLPFSWVYGREVQL

SEQ ID NO: 2712 - protein, 432 aa, Oryza sativa
  source: /note="subsp. japonica"
MTGAVSKLAAPRPAAAAPLPPASVRSAFLASAPSPRRFSVSIAAGRARSPIIAMASAKEGNGAPTKRTTLHDLYDLQGQSPWYDNLCRPVTDLLPLIGSGVRGVTSNPSIFQKAISTSNAYDDQFKQLILAGKDAESAYWELVIKDIQDACKLFEPIYDQTDGADGYVSVEVSPRLANDTQGTVEAAKWLHKVVDRPNVYIKIPATAECVPSIKEVIANGISVNVTLIFSIARYEAVIDAYIDGLEASGLSDLSRVTSVASFFVSRVDTLIDKMLEKIGTPEALALRGKAAVAQAKLANQLYQKKFSGPRWEALVKKGAKKQRLLWASTSVKNPAYPDTLYVDPLIGPDTVSTMPDQALLAFIDHGTVSRTIDANVSDAEGVYSALEKLGIDWDEVGKQLELEGVDSFKKAFDSLLGSLEEKGNSLKKTVSL

SEQ ID NO: 2713 - protein, 441 aa, Oryza sativa; identical to SEQ ID NO: 846
  source: /note="subsp. japonica"

SEQ ID NO: 2714 - protein, 445 aa, Oryza sativa
  source: /note="subsp. japonica"
MDEEYDVIVLGTGLKECILSGLLSVDGLKVLHMDRNDYYGGDSTSLNLNQLWKRFRGEDKPPAHLGSSKDYNVDMVPKFMMANGTLVRTLIHTDVTKYLSFKAVDGSYVFSKGKIHKVPATDMEALKSPLMGLFEKRRARNFFIYVQDYNEADPKTHQGLDLTTMTTRELIAKYGLSDDTVDFIGHALALHRDDRYLNEPAIDTVKRMKLYAESLARFQGGSPYIYPLYGLGELPQGFARLSAVYGGTYMLNKPDCKVEFDMEGKVCGVTSEGETAKCKKVVCDPSYLPNKVRKIGKVARAIAIMSHPIASTNDSHSVQIILPQKQLGRKSDMYVFCCSYTHNVAPKGKFIAFVSTEAETDNPQSELKPGIDLLGQVDELFFDIYDRYEPVNEPSLDNCFVSTSYDATTHFETTVTDVLNMYTLITGKAVDLSVDLSAASAAEEY

SEQ ID NO: 2715 - protein, 482 aa, Oryza sativa
  source: /note="subsp. japonica"
MAAAANGAACCGGATGPGYATPLEAMEKGPREKLLYVTCVYNGTGINKPDYLGTVDVDPNSPTYSQVIHRLPVTHVGDELHHSGWNACSSCHGDPSASRRFLILPSLLSGRVYVVDTLKDPRAPALHKVVEAEDIAEKTGLGFPHTSHCLASGEIMISCLGDKEGNAAGNGFLLLDSEFNVKGRWEKPGHSPLFGYDYWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIKPLKVRNWILPEMPGLITDFVISLDDRYLYLVNWLHGDIRQYNIEDPAKPVLAGQVWAGGLLQKGSEVVYVTEDDKEEQYSVPQVKGHRLRGGPQMIQLSLDGKRIYVTNSLFSRWDEQFYGQDLVKKGSHMLQIDVDTEKGGLSINPNFFVDFGAEPEGPSLAHEMRYPGGDCTSDIWI

SEQ ID NO: 2716 - protein, 511 aa, Oryza sativa
  source: /note="subsp. japonica"
MAAMDLRVAAPASVAAAARCGTSLARPWPARAVGGGGGGGGRGRRLSVRTSVATTEAAAAAVGASEDAALEARDSKTVVAVILGGGAGTRLFPLTKRRAKPAVPIGGAYRLIDVPMSNCINSGINKVYILTQFNSASLNRHLSRAYNFSNGVAFGDGFVEVLAATQTPGSEGKRWFQGTADAVRQFDWLFDDAKAKDIDDVLILSGDHLYRMDYMDFVQSHRQRGADISICCLPIDDSRASDFGLMKIDDTGRVIAFSEKPKGDDLKAMQVDTTVLGLPQDEAKEKPYIASMGVYIFKKEILLNLLRWRFPTANDFGSEIIPASAKEINVKAYLFNDYWEDIGTIKSFFEANLSLAEQPPRFSFYDANKPMYTSRRNLPPSMINNSKITDSIISHGCFLDSCRIEHSVVGIRSRIGSNVHLKDTVMLGADFYETDLERGELLAEGKVPIGIGENTKIQNCIIDKNARIGKNVTISNSEGVQEADRTSEGFYIRSGITIVLKNSIIADGLVI

SEQ ID NO: 2717 - protein, 548 aa, Oryza sativa
  source: /note="subsp. japonica"
PSSSLITPPIPSSSAAKHLASSAMATATASSLSLLFAHPHSSNPRPFAGGPHLRRPLRAAPHRARCASDAATTATRHRRPAEENIREEAARLRGPGNDFSAWYVPFPPTPEDDPDERYSLDEVVYRSSSGGLLDVCHDMEALARFPGSYWRDLFDSRVGRTAWPYGSGVWSKKEFVLPEIDSDHIVSLFEGNSNLFWAERLGREHLGGMTDLWVKHCGISHTGSFKDLGMTVLVSQVNRLRRAPLSRPINGVGCASTGDTSAALSAYCAAAGIPAIVFLPADRISLQQLIQPIANGATVLSLDTDFDGCMRLIREVTAELPIYLANSLNSLRLEGQKTAAIEILQQFDWQVPDWVIVPGGNLGNIYAFYKGFEMCRVLGLVDRVPRLVCAQAANANPLYRFYKSGWTDFQPRVAETTFASAIQIGDPVSVDRAVVALKATDGIVEEATEEELMDAMSLADRTGMFACPHTGVALAALFKLRDQRIIGPNDRTVVVSTAHGLKFTQSKIDYHDRNIKDMLCQYANPPINVKADFASVMDVLQNKLNGKI

SEQ ID NO: 2718 - protein, 542 aa, Oryza sativa
  source: /note="subsp. japonica"
VISLMQKPGATGGGTPVVDMESFFTSVIVPELQAPDWESEPMLKATVLRFLKEFKDQIPKATALALLPSVIRFLIHESNVVHSYAATFIENLLIIKDMVPVPSANVITRAPRYVAADINPYAQPIVQNLSKALSFPESYENPYLMKCLMRVLGIANIAGQIVHEITARLVGILMEVCNNPKNPDFNHYLFEALAAVIGRAGEQDPALLPVFEASLFPVLQRILVEDISEFWPYAFQIFAQLVNLSRPPLSQNYMQLFGVLLSNATWDRPPCVPALVRLLRAFLRKIPNELNQEGRLPNILVIFRSLLSRSSTEDSAFYMLNTLVENVSFDIMNPHINEIWSALFTRLQTRQAVKFVNSLVVFMSLVVVKYGPGVLVSSVDAIQPNIFMTILQRFWIPNLKFIKGTVEVKLTSVASTKLICESALLLDGAAAQTWGKLLDSIVALLSRTDQDGAQQDQNDGADADSQRTSGYSVSFVRLQYAGKSEDDLLKEVNDPKQFLVTSLATLSAQSPGRFGPIIEQNVDPANKGALIQLCAAYNTNIV

SEQ ID NO: 2719 - protein, 567 aa, Oryza sativa
  source: /note="subsp. japonica"
MAAAAVAANGGGDGAQASNAPAPTRLASVYSEVQTSRLKHALPLPSVLRSPFALADGPASSAAGNPGEIAKLFPNLFGQPSVSLVPSPEPASTRPLKVGVVLSGGQAPGGHNVICGIFDYLQEYAKGSVMYGFKGGPAGVMKCKYVELTADYVYPYRNQGGFDMICSGRDKIETPEQFKQAEDTVNKLDLDGLVVIGGDDSNTNACLLAEYFRGKNMKTRVIGCPKTIDGDLKCKEVPTSFGFDTACKIYSEMIGNVMTDARSTGKYYHFVRLMGRAASHITLECALQTHPNVALIGEEVAAKKETLKSVTDYITDIVCKRAELGYNYGVILIPEGLIDFIPEVQKLIAELNEILAHDVVDEAGAWKSKLQPESRQLFDFLPKTIQEQLLLERDPHGNVQVAKIETEKMLIAMVETELEKRKAEGKYPAHFRGQSHFFGYEGRCGLPTIFDSNYCYALGYGSGALLQCGKTGLITSVGNLAAPVEEWTVGGTALTSLMDVERRHGKYKPVIKKAMVELDGAPFKKFASLRDEWSLKNHYISPGPIQFSGPGSNDANHTLMLELGAEA

SEQ ID NO: 2720 - protein, 608 aa, Oryza sativa
  source: /note="subsp. japonica"
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGVPESDTKQLISYARANNKVIIGPATVGGIQAGAFKIGDTAGTIDNIIQCKLYRPGSVGFVSKSGGMSNEMYNTIARVTDGIYEGIAIGGDVFPGSTLSDHILRFNNIPQVKMMVVLGELGGKDEYSLVEALKQGKVQKPVVAWVSGTCARLFKSEVQFGHAGAKSGGELESAQAKNQALKDAGAVVPTSYEALETAIKETFEKLVEDGKISPVTEITPPPIPEDLKTAIKSGKVRAPTHIISTISDDRGEEPCYAGVPMSTIIEQGYGVGDVISLLWFKRSLPRYCTQFIEMCIMLCADHGPCVSGAHNSIVTARAGKDLVSSLVSGLLTIGPRFGGAIDDAARYFKDAYDRNLTPYEFVEGMKKKGIRVPGIGHRIKSRDNRDKRVQLLQKYAHTHFPSVKYMEYAVQVETYTLSKANNLVLNVDGAIGSLFLDLLSGSGMFSKQEIDEIVEIGYLNGLFVLARSIGLIGHTFDQKRLKQPLYRHPWEDVLYTK

SEQ ID NO: 2721 - protein, 644 aa, Oryza sativa
  source: /note="subsp. japonica"
MATTAAAAAAALSAAATAKTGRKNHQRHHVLPARGRVGAAAVRCSAVSPVTPPSPAPPATPLRPWGPAEPRKGADILVEALERCGVSDVFAYPGGASMEIHQALTRSPVITNHLFRHEQGEAFAASGYARASGRVGVCVATSGPGATNLVSALADALLDSVPMVAITGQVPRRMIGTDAFQETPIVEVTRSITKHNYLVLDVEDIPRVIQEAFFLASSGRPGPVLVDIPKDIQQQMAVPVWDTSMNLPGYIARLPKPPATELLEQVLRLVGESRRPILYVGGGCSASGDELRWFVELTGIPVTTTLMGLGNFPSDDPLSLRMLGMHGTVYANYAVDKADLLLAFGVRFDDRVTGKIEAFASRAKIVHIDIDPAEIGKNKQPHVSICADVKLALQGLNALLQQSTTKTSSDFSAWHNELDQQKREFPLGYKTFGEEIPPQYAIQVLDELTKGEAIIATGVGQHQMWAAQYYTYKRPRQWLSSAGLGAMGFGLPAAAGASVANPGVTVVDIDGDGSFLMNIQELALIRIENLPVKVMVLNNQHLGMVVQWEDRFYKANRAHTYLGNPECESEIYPDFVTIAKGFNIPAVRVTKKSEVRAAIKKMLETPGPYLLDIIVPHQEHVLPMIPSGGAFKDMILDGDGRTVY

SEQ ID NO: 2722 - protein, 726 aa, Oryza sativa
  source: /note="subsp. japonica"
MAGAIRVTMEVGADGVAVVTICNPPVNALHPIIIQGLKEKYAEAMDRDDVKAIVLTGAGGKFCGGFDINVFTEVHKTGNVSLMPDVSVELVSNLMEAGKKPSVAAIQGLALGGGLELTMGCHARISTPEAQLGLPELTLGIIPGFGGTQRLPRLVGLPKAIEMMLQSKFITAKEGKEGGLVDALCSPDELIKMSRLWALEIANYRKPWIRSLARTDRLGSLSEARSVLNSARQQAKKVAANLPQHQACLDVMEEGVLCGGHAGVLKEAKVFKELVLSPTSKALVHAFFAQRLTTKVPGVTDVQLKPRKIRKVAVIGGGLMGSGIATALLVSNTSVVLKEVNPQFLQRGQKMIAANLEGLVKRGSLTKDKMNKAMSLLKGALDYSDFKDVDMVIEAVIEKIPLKQSIFSDLEKVCPPHCILATNTSTIDLNVVGEKTNSQDRIIGAHFFSPAHIMPLLEIVRTEKTSPQAILDLITVGKMIKKVPVVVGNCTGFAVNRTFFPYTQGSHLLVSIGIDVFRIDRVISSFGMPMGPFQLQDLAGYGVALAVKDIYAAAFGTRNLDSNLVDLMVQNGRQGKSNGKGYYLYEKGGKPKPDPSVQVVIDEYRRCAKTMPGGKPVTLSDQDILEMIFFPVVNEACRVMDENVVIRASDLDIASILGMGFPKFRGGLVFWADTIGAPYIHSKLSKWTEIYGDFFKPSSYLEDRAKRSLPLSAPNATQQASSRSRM

SEQ ID NO: 2723 - protein, 845 aa, Oryza sativa
  source: /note="subsp. japonica"
MSVVGFDLGNESCIVAVARQRGIDVVLNEESKRETPAIVCFGDKQRFIGTAGAASSTMNPKNSVSQIKRLLGRKYSDPELQRDIAAFPFRVSEGPDGFPLVHARYLGEERVFTPTQLMAMVLSNLKGIAESNLNTAVVDCCIGIPVYFTDLQRRAVLDAATIAGLCPLRLFHETTATALAYGIYKTDLPENDQLNVAFVDVGHASMQVCIAGYKKGQLKILSHAYDRSLGGRDFDEVLFKHFAAKFKDEYKIDVYQNARACIRLRVACEKLKKVLSANPESPMHIECLMDEKDVRGFIKREEFEKISASILERVKGPLEKALAEAGLTTENVHFVEVVGSGSRVPAIIKILTDFFGKEPRRTMNASECVARGCALECAILSPTFKVREFQVNDGFPFSIAMSWKPDSQNGDNQQTVVFPKGNPLPSVKALTFYRSNTFQVDVTYVDTGDLQISPKISTYTVGPFNPGKGDKAKLKVKVRLNIHGVVTVESATMLEEEEVEVPVAATTEPPKDSAKMETDDAPNEAASGTDVNMQEAKAPADAAADGAENGAPNSEEKSVPMETDAKVEPSKKKVKKTNVPVAELVYGALGTTELQKAVEKEYEMALQDRVMEETKDKKNAVESYVYDMRNKLYDKYNDFVTAEDKEAFIAKLQEVEDWLYEDGEDETKGVYVAKLEELKKVGGPIEARYKEWMDRGPSIDQLAYCINSFRDAALSKDPKFDHIEMEEKQKVINQCSEAEVWLREKIQQQDALPKHANPVLLSSDLKKKAETVDRFCKPIMMKPKPAPKPQTPPQTPPTETPAGGAQTPEQQPQGAEAAGEASEGGASESTGEQMETDKPEGTEAA

SEQ ID NO: 2724 - protein, 872 aa, Oryza sativa
  source: /note="subsp. japonica"
MSLDITQVLLSAQSPDGATRKLAEESLKQFQEQNLPGFLFSLSNELANEEKPEESRRLAGLILKNALDAKEQHRKNELFQRWLALDVGVKAQIKGFLLQTLSSPVASARSTSSQVIAKVAGIEIPQKQWPELIASLLSNIHQVQPNVKQATLETLGYLCEEVSPEAVDQDQVNKILTAVVQGMNASEGNSDVRLAATRALYNALGFAQVNFSNDMERDYIMRVVCEATQSTDVKIRQAAFECLVAISSTYYDKLATYMQDIFNITAKAVRGDEESVALQAIEFWSSICDEEIDILDEYSSEFTADSDVPCYYFIKQALPALVPMLLETLLKQEEDQDLDEGAWNLAMAGGTCLGLVARTVGDDIVPLVMPFVEENITKPDWRHREAATYAFGSILEGPSADKLAPLVNVALNFMLSALVNDPSNHVKDTTAWTLGRIFEFLHGSALETAPIITSENCQQILTVLLQSMKDVPNVAEKACGALYFLAQGYVDAGSASPLTPFFQDIIQSLLFVTHREDAGESRLRTAAYETLNEVVRCSIEETGPIVMQLVPVIMMELHQTLEAGKLSTDEREKRSELQGLLCGCLQVIIQKLGAMESTKYSFLQYADQMMELFLRVFACRNATVHEEAMLAIGALAYAAGPNFSKYMPQFYQYLEMGLQNFEEYQVCAITVGVVGDLCRALEDKILPYCDGIMTQLLKDLSSNQLHRSVKPPIFSCFGDIALAIGENFEKYLIYAMPMLQSAADLSAHAAAADDEMLDYTNQLRNGILEAYSGILQGFKSSPKTQLLMQYAPNILNFLDALYNGKDMDDTVMKTAIGVLGDLADTLGVHAGPLINQSISSKKFLEECLASDDPLVKESADWARVAISRAVSG

SEQ ID NO: 2725 - protein, 457 aa, Solanum lycopersicum
MVIQRNSILLLIIIFASSISTCRSNVIDDNLFKQVYDNILEQEFAHDFQAYLSYLSKNIESNNNIDKVDKNGIKVINVLSFGAKGDGKTYDNIAFEQAWNEACSSRTPVQFVVPKNKNYLLKQITFSGPCRSSISVKIFGSLEASSKISDYKDRRLWIAFDSVQNLVVGGGGTINGNGQVWWPSSCKINKSLPCRDAPTALTFWNCKNLKVNNLKSKNAQQIHIKFESCTNVVASNLMINASAKSPNTDGVHVSNTQYIQISDTIIGTGDDCISIVSGSQNVQATNITCGPGHGISIGSLGSGNSEAYVSNVTVNEAKIIGAENGVRIKTWQGGSGQASNIKFLNVEMQDVKYPIIIDQNYCDRVEPCIQQFSAVQVKNVVYENIKGTSATKVAIKFDCSTNFPCEGIIMENINLVGESGKPSEATCKNVHFNNAEHVTPHCTSLEISEDEALLYNY

SEQ ID NO: 2726 - protein, 377 aa, Solanum lycopersicum
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVSPDEHPVLLTEAPLNPKANREKMTQIMFETFNVPAMYVAIQAVLSLYASGRTTGIVLDSGDGVSHTVPIYEGYALPHAILRLDLAGRDLTDCLMKILTERGYSFTTSAEREIVRDMKEKLAYVALDYEQELETARSSSAVEKSYELPDGQVITIGAERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWITKGEYDESGPSIVHRKCF

SEQ ID NO: 2727 - protein, 546 aa, Solanum lycopersicum
MANPQQPLLIKTHKQNPIISFKILSFVITLFVALFLVAPYQVEIKHSNLCKTAQDSQLCLSYVSDLISNEIVTTESDGHSILMKFLVNYVHQMNNAIPVVRKMKNQINDIRQHGALTDCLELLDQSVDFASDSIAAIDKRSRSEHANAQSWLSGVLTNHVTCLDELDSFTKAMINGTNLEELISRAKVALAMLASLTTQDEDVFMTVLGKMPSWVSSMDRKLMESSGKDIIANAVVAQDGTGDYQTLAEAVAAAPDKSKTRYVIYVKRGTYKENVEVASNKMNLMIVGDGMYATTITGSLNVVDGSTTFRSATLAAVGQGFILQDICIQNTAGPAKDQAVALRVGADMSVINRCRIDAYQDTLYAHSQRQFYRDSYVTGTVDFIFGNAAVVFQKCQLVARKPGKYQQNMVTAQGRTDPNQATGTSIQFCNIIASSDLEPVLKEFPTYLGRPWKEYSRTVVMESYLGGLINPAGWAEWDGDFALKTLYYGEFMNNGPGAGTSKRVKWPGYHVITDPAKAMPFTVAKLIQGGSWLRSTGVAYVDGLYD

SEQ ID NO: 2728 - protein, 377 aa, Solanum lycopersicum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDMKEKLAYVALDYEQELETARSSSSIEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 2729 - protein, 448 aa, Solanum lycopersicum
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKGAASFTAQVIIMNHPGQIGNGYAPVLDCHTSHIAVKFAEILTKIDRRSGKELEKEPKFLKNGDAGMVKMIPTKPMVVETFAEYPPLGRFAVRDMRQTVAVGVVKNVDKKDPTGAKVTKAAQKKGK

SEQ ID NO: 2730 - protein, 550 aa, Solanum lycopersicum
MATPQQPLLTKTHKQNSIISFKILTFVVTLFVALFLVVFLVAPYQFEIKHSNLCKTAQDSQLCLSYVSDLISNEIVTSDSDGLSILKKFLVYSVHQMNNAIPVVRKIKNQINDIREQGALTDCLELLDLSVDLVCDSIAAIDKRSRSEHANAQSWLSGVLTNHVTCLDELDSFTKAMINGTNLDELISRAKVALAMLASVTTPNDEVLRPGLGKMPSWVSSRDRKLMESSGKDIGANAVVAKDGTGKYRTLAEAVAAAPDKSKTRYVIYVKRGTYKENVEVSSRKMNLMIIGDGMYATIITGSLNVVDGSTTFHSATLAAVGKGFILQDICIQNTAGPAKHQAVALRVGADKSVINRCRIDAYQDTLYAHSQRQFYRDSYVTGTIDFIFGNAAVVFQKCQLVARKPGKYQQNMVTAQGRTDPNQATGTSIQFCDIIASPDLKPVVKEFPTYLGRPWKKYSRTVVMESYLGGLIDPSGWAEWHGDFALKTLYYGEFMNNGPGAGTSKRVKWPGYHVITDPAEAMSFTVAKLIQGGSWLRSTDVAYVDGLYD

SEQ ID NO: 2731 - protein, 337 aa, Solanum lycopersicum
MAKVKIGINGFGRIGRLVARVALQRNDVELVAVNDPFISVDYMTYMFKYDSVHGQWKHHELKVKDEKTLLFGEKAVTVFGFRNPEEIPWAQTGADYIVESTGVFTDKDKAAAHLKGGAKKVIISAPSKDAPMFVVGVNEKEYKPELNIVSNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEATYDEIKAAIKEESEGKLKGILGYTEDDVVSTDFVGDNRSSIFDAKAGIALSKNFVKLVAWYDNEWGYSTRVVDLIIHMSSVQ

SEQ ID NO: 2732 - protein, 485 aa, Solanum lycopersicum
MALLVEKTTSGREYKVKDMSQADFGRLEIELAEVEMPGLMASRAEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTVPDPTSTDNVEFQLVLTIIKESLKTDPLRYTKMKERLVGVSEETTTGVKRLYQMQANGSLLFPAINVNDSVTKSKFDNLYGCRHSLPDGLMRATDVMIAGKVALVAGYGDVGKGCAAAMKQAGARVIVTEIDPICALQATMEGLQVLPLEDVVSEVDIFVTTTGNKDIIMVDHMRKMKNNAIVCNIGHFDNEIDMHGLETFPGVKRITIKPQTDRWVFPDTNSGIIVLAEGRLMNLGCATGHPSFVMSCSFTNQVIAQLELWNERSSGKYEKKVYVLPKHLDEKVAALHLGKLGAKLTKLTKDQADYISVPVEGPYKPAHYRY

SEQ ID NO: 2733 - protein, 583 aa, Solanum lycopersicum
MTRVEDFFSKQIDFCKRKKKIYLAIVASVLLVAAVIGVVAGVKSHSKNSDDHADIMAISSSAHAIVKSACSNTLHPELCYSAIVNVSDFSKKVTSQKDVIELSLNITVKAVRRNYYAVKELIKTRKGLTPREKVALHDCLETMDETLDELHTAVEDLELYPNKKSLKEHAEDLKTLISSAITNQETCLDGFSHDEADKKVRKVLLKGQKHVEKMCSNALAMICNMTDTDIANEMKLSAPANNRKLVEDNGEWPEWLSAGDRRLLQSSTVTPDVVVAADGSGDYKTVSEAVAKAPEKSSKRYVIRIKAGVYRENVDVPKKKTNIMFMGDGKSNTIITASRNVQDGSTTFHSATVAAVGEKFLARDITFQNTAGASKHQAVALRVGSDLSAFYRCDMLAYQDTLYVHSNRQFFVQCLVAGTVDFIFGNGAAVFQDCDIHARRPGSGQKNMVTAQGRTDPNQNTGIVIQKCRIGATSDLRPVQKSFPTYLGRPWKEYSRTVIMQSSITDVIQPAGWHEWNGNFALDTLFYGEYANTGAGAPTSGRVKWKGHKVITSSTEAQAYTPGRFIAGGSWLSSTGFPFSLGL

SEQ ID NO: 2734 - protein, 337 aa, Solanum lycopersicum
MGKVKIGINGFGRIGRLVARVALQSDDIELVAVNDPFITTEYMTYMFKYDTVHGQWKKHELKVKDDKTLLFGDKPVKVFGARNPEEIPWGEAGADYVVESTGVFTDKDKAAAHLKGGAKRVVISAPSKDAPMFVMGVNEKEYKADINIVSNASCTTNCLAPLAKVINDKFGIVEGLMTTVHSITATQKTVDGPSMKDWRGGRAAAHNIIPSSTGAAKAVGKVLPALNGKLTGMAFRVPTVDVSVVDLTARIQKSATYDEIKAALKAESQGNMKGILGYTEDDVVSSDFIGDCRSSIFDAKAGIALNGNFVKVVSWYDNEWGYSNRVIDLIRHMSTVV

SEQ ID NO: 2735 - protein, 110 aa, Solanum lycopersicum; identical to SEQ ID NO: 536

SEQ ID NO: 2736 - protein, 137 aa, Solanum lycopersicum
KPAEKKPAEKTPVAEKAPAEKKPKAGKKLPKDAAAGDKKKKRSKKAVETYKIYIFKVLKQVHPDIGISSKAMGIMNSFINDIFEKLAQEASRLARYNKKPTITSREIQTAVRLVLPGELAKHAVSEGTKAVTKFTSS

SEQ ID NO: 2737 - protein, 419 aa, Solanum lycopersicum
MAFSSLLKPAASFVRPSHRSQVSCAGLHHSSNSVKLQSSIFGDAVTILQSSSLQKSGACSIQPIRATATELPPTVPRSQTGGKTRVGINGFGRIGRLVLRIATFRDDIEVVAVNDPFIDAKYMAYMLKYDSTHGVYSGSISVLDDSTLEINGKQIKVSSKRDPADIPWGDLGADYVVESSGVFTTIDKASAHKKGGAKKVVISAPSADAPMFVVGVNEKTYKANMDVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRLDKSASYDDVKAAIKYASEGPLKGILGYTDEDVVSNDFVGDSRSSIFDAKAGIGLSKSFVKLVSWYDNEWGYSNRVLDLIEHMALVASIH

SEQ ID NO: 2738 - protein, 636 aa, Solanum lycopersicum
MATQCYDPENSASRYTLLPDQPDSGHRKSLKIISGIFLSVFLLLSVAFFPILNNQSPDLQIDSRSPAPPSRGVSQGVSDKTFRDVAGASHVSYAWSNAMLSWQRTAYHFQPQKNWMNDPNGPLYHKGWYHLFYQYNPDSAIWGNITWGHAVSKDLIHWLYLPFAMVPDQWYDINGVWTGSATILPDGQIMMLYTGDTDDYVQVQNLAYPANLSDPLLLDWVKFKGNPVLVPPPGIGVKDFRDPTTAWTGPQNGQWLLTIGSKIGKTGVALVYETSNFTSFKLLDGVLHAVPGTGMWECVDFYPVSTKKTNGLDTSYNGPGVKHVLKASLDDNKQDHYAIGTYDLGKNKWTPDNPELDCGIGLRLDYGKYYASKTFYDPKKERRVLWGWIGETDSESADLQKGWASVQSIPRTVLYDKKTGTHLLQWPVEEIESLRVGDPTVKQVDLQPGSIELLRVDSAAELDIEASFEVDKVALQGIIEADHVGFSCSTSGGAASRGILGPFGVIVIADQTLSELTPVYFYISKGADGRAETHFCADQTRSSEAPGVGKQVYGSSVPVLDGEKHSMRLLVDHSIVESFAQGGRTVITSRIYPTKAVNGAARLFVFNNATGASVTASVKIWSLESANIQSFPLQDL

SEQ ID NO: 2739 - protein, 727 aa, Solanum lycopersicum
MKEKTQTPICSLFFLVLCFLCCSVFTEHTNAEFTVSENGPLTDSEAQFIKHRQLLYYRDEFGDRGENVKIDPSMVFENDRIKNAYIALQAWKQAIISDPFNITMNWVGPNVCSYTGVFCAPALDNPKIRTVAGIDLNHGDIAGYLPEELGLLTDLGIFHINSNRFCGTIPRKLNKLKILFELDLSNNRFAGKFPYVVLSLPKLIFLDIRFNEFEGNVPSQLFDKPLDAIFINHNRFAFELPENFGNSPVSVIVLASNSFHGCLPASIGNMSNLNEAILMNNGLRSCLPAEIGLLKNLTVFDVSFNELMGPLPENFGGLVNLEQLNVAHNMLSGTIPKSICQLPKLENFTYSYNFFTGEPPVCLALPEFHDQRNCLPNRPVQRSPGQCKAFLSKKIHCSAFKCHKFVPVLPPPPPLSPPLPAPPPPPVYSPPPPVYNPPSPPPPPPPSPPPPSPPPPVYSPPPPSPPPPPPVYSPPPPPPSPPPPSPPPPPPPSPPPPSPPPPVYSPPPPPPPPPPPVYSPPPLPYCVRSPPPPPPPPNSPPPNSPPPPLAHSPPPPSPYYYNSPPPPPPNSPPPPPNSPPPPPPTYIYSSPPPPNSPPPPPPPYVYSSPPPPHSPPPPSPLPCIEPPPPPPPCIEPPPPPSPSPSPPPPPMYHYNSPPPPSPSPPPPPVYHYNSPPPPSPSPPPPPVYYYNSPPPPPPSPPPTPVYEGPLPPVIGVQYASPPPPPFY

SEQ ID NO: 2740 - protein, 358 aa, Solanum lycopersicum
MSCYKGKYADELIKNATYIGTPGKGILAADESTGTIGKRLSSINVENVESNRRALRELLFCTPGCLQYLSGVILFEETLYQKTAAGKPFVEVMKEAGVLPGIKVDKGTVELPGTDGETTTQGLDGLAERCQKYYEAGARFAKWRAVLKIGANEPSQLAINDNANGLARYAIICQQNGLVPIVEPEILVDGAHDIKKCADVTERVLAACYKALNDHHVLLEGTLLKPNMVTPGSESPKVAPEVIAEYTVRALQRTMPPAVPAVVFLSGGQSEEEATVNLNAMNKLQTKKPWSLSFSFGRALQQSTLKAWGGKEENVQKAQAAFLTRCKANSEATLGKYVGASNLSEGASESLHVKDYKY

SEQ ID NO: 2741 - protein, 363 aa, Solanum lycopersicum
MESPRVEESYDKMSELKAFDDTKAGVKGLVDSGITKVPQIFVLPPKDRAKKCETHFVFPVIDLQGIDEDPIKHKEIVDKVRDASEKWGFFQVVNHGIPTSVLDRTLQGTRQFFEQDNEVKKQYYTRDTAKKVVYTSNLDLYKSSVPAASWRDTIFCYMAPNPPSLQEFPTPCGESLIDFSKDVKKLGFTLLELLSEGLGLDRSYLKDYMDCFHLFCSCNYYPPCPQPELTMGTIQHTDIGFVTILLQDDMGGLQVLHQNHWVDVPPTPGSLVVNIGDFLQLLSNDKYLSVEHRAISNNVGSRMSITCFFGESPYQSSKLYGPITELLSEDNPPKYRATTVKDHTSYLHNRGLDGTSALSRYKI

SEQ ID NO: 2742 - protein, 521 aa, Solanum lycopersicum
MAASIGALKSSPSSHNCINERRNDSTRAISSRNLSFSSSHLAGDKLMPVSSLRSQGVRFNVRRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGEYKNEGFVEVLAAQQSPENPDWFQGTADAVRQYLWLFEEHNVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDAERKLLAAKGSVPIGIGKNCLYKRAIIDKNARIGDNVKIINKDNVQEAARETDGYFIKSGIVTVIKDALIPSGIVI

SEQ ID NO: 2743 - protein, 602 aa, Solanum lycopersicum
MASITASHFVSRSSNVQTSLDTKSTLSQIGLRNHTLTHNGLRAVNKLDGLQSRTNTKVTPKMRSTKSATIVCGKGMNLIFVGTEVGPWSKTGGLGDVLGGLPPALAARGHRVMTISPRYDQYKDAWDTSVALEVKVGDSIEIVRFFHCYKRGVDRVFVDHPMFLEKVWGKTGSKIYGPKAGLDYLDNELRFSLLCQAALEAPRVLNLNSSNYFSGPYGEDVLFIANDWHTALIPCYLKSMYQSRGIYLNAKVAFCIHNIAYQGRFSFSDFPLLNLPDEFRGSFDFIDGYEKPVKGRKINWMKAGILESHRVVTVSPYYAQELVSAVDKGVELDSVLRKTCITGIVNGMDTQEWNPATDKYTDVKYDITTVMDAKPLLKEALQAAVGLPVDKKIPLIGFIGRLEEQKGSDILVAAIHKFIELDVQIVVLGTGKKEFEQEIEQLEVLYPNKAKGVAKFNVPLAHMITAGADFMLVPSRFEPCGLIQLHAMRYGTVPICASTGGLVDTVKEGYTGFHMGAFNVECDVVDPDDVLKIVTTVSRALAVYGTLAFAEMIKNCMSEELSWKEPAKKWETLLLGLGASGSEPGVEGEEIAPLAKENVATP

SEQ ID NO: 2744 - protein, 619 aa, Solanum lycopersicum
MFSDPFNFTANWTGPNVCSYGGVFCAPSLMDDSIRVVAGIDLNHADIAGSLVAELGLLTDLVLFHLNSNRFCGVVPKTFSHLKLLRELDLSNNRFVGGFPKVVLSLPSLKFLDLRFNDFEGPVPSGLFDKDLDALFLNDNRFRFGIPENLGNSPVSVLVFANNDLGGCIPASIGKMGKTLNELILMNDNLTGCLPMEIGLLNKLTVFDVSFNKIQGSLPSTVSKMRSVEELNVAHNKLTGVIPASICQLPRLQNFTYSFNYFTGEAPVCAATRSGDGQENCIVGKKNQRSAKECSSDDAKPYDCRKSKCYSPFATSPSTKPKPKPKPRGPPPPTWKSSGSHNKRSPPPPKSTPLPPPAPYKKSPTYQHRSPPPPTHKISPVTHHSPPPPSPVYYHPSPSSPPPPVYYSPPPPVYHEPPPTYKPKSPPPPPTPSYEHPKTPSPLPPTPSYEHPKTPPSHEHPKTPSPPTPSYEHPKTPSPPTPSYEHPKTPSPPPPTPSYEHPQPQSPPPPPTPSYEHPKTPSHPTPPTPPCNEPPPPPPNSHWEPKPSPPYTYSSPPPPSPSPPPPTYYYSSPPPPSPSPPPPTYSSPPPPPPFYENIPLPPVIGVSYASPPPPVIPYY

SEQ ID NO: 2745 - protein, 828 aa, Solanum lycopersicum
MVKFTAEELRRIMDFKHNIRNMSVIAHVDHGKSTLTDSLVAAAGIIAQEVAGDVRMTDTRADEAERGITIKSTGISLYYEMTDDSLRNFKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGTASCKRGFVQFCYEPIKQIINTCMNDQKDKLWPMLQKLGVTMKSDEKDLMGKALMKRVMQTWLPASTALLEMMIYHLPSPSTAQKYRVENLYEGPLDDAYANAIRNCDPEGPLMLYVSKMIPASDKGRFFAFGRVFAGKVSTGMKVRIMGPNYVPGEKKDLYVKNIQRTVIWMGKRQETVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSTRTVMSKSPNKHNRLYMEARPMEEGLAEAIDEGRIGPRDDPKVRSKILAEEFGWDKDLAKKIWCFGPETTGPNMVVDMCKGVQYLNEIKDSVVAGFQWASKEGALAEENMRGICFEVCDVVLHSDAIHRGGGQVIPTARRVIYASQLTAPEQALGGIYSVLNQKRGHVFEEMQRPGTPLYNIKAYLPVVESFGFSGTLRAATSGQAFPQCVFDHWEMMSSDPLEAGSQAHQLVLDIRKRKGLKDQMTPLSEFEDKL

SEQ ID NO: 2746 - protein, 896 aa, Solanum lycopersicum
MLKPQFQQSTKTLIPSWNTNTLFLASFPINILNKNFILKKKNNFRVHHNYNGANTIKAVLNSTQKSIGVKAVVTVQKQVNLNLLRGLDGIGDLLGKSLILWIVAAELDHKTGLEKPSIRSYAHRGLDVDGDTYYEAVFEIPEDFGEVGAILVENEHHKEMYVKNIVIDGFVHGKVEITCNSWVHSKFANPDKRIFFTNKSYLPSQTPSGVIRLREEELVTLRGDGVGERKVFERIYDYDVYNDLGEVDSNNDDAKRPILGGKKLPYPRRCRTGRQRSKKDPLYETRSTFVYVPRDEAFSAVKSLTFSGNTVYSALHAVVPALESVVSDPDLGFPHFPAIDSLFNVGVDLSGLSDKKSSLFNIVPRLIKSISETGKDVLLFESPQLVQRDKFSWFRDVEFARQTLAGLNPYSIRLVTEWPLRSNLDPKVYGPPESEITKELIENEIGNNMTVEQAVQQKKLFILDYHDLLLPYVNKVNELKGSVLYGSRTIFFLTPHGTLKPLAIELTRPPIDDKPQWKEVYSPNNWNATGAWLWKLAKAHVLSHDSGYHQLVSHWLRTHCCTEPYIIATNRQLSAMHPIYRLLHPHFRYTMEINALAREALINANGIIESSFFPGKYSVELSSIAYGAEWRFDQEALPQNLISRGLAEEDPNEPHGLKLAIEDYPFANDGLVLWDILKQWVTNYVNHYYPQTNLIESDKELQAWWSEIKNVGHGDKKDEPWWPELKTPNDLIGIITTIVWVTSGHHAAVNFGQYSYGGYFPNRPTTARSKMPTEDPTAEEWEWFLNKPEEALLRCFPSQIQATKVMTILDVLSNHSPDEEYIGEKIEPYWAEDPVINAAFEVFSGKLKELEGIIDARNNDSKLNNRNGAGVMPYELLKPYSEPGVTGKGVPYSISI

SEQ ID NO: 2747 - protein, 78 aa, Solanum lycopersicum; identical to SEQ ID NO: 594

SEQ ID NO: 2748 - protein, 96 aa, Solanum lycopersicum; identical to SEQ ID NO: 531

SEQ ID NO: 2749 - protein, 156 aa, Solanum lycopersicum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDTGKVQRLRKECPNAECGAGTFMANHFDRHYCGKCGLTYVYNKAGGD

SEQ ID NO: 2750 - protein, 292 aa, Solanum lycopersicum
MAKKLVKYCVVDAFTDTAFKGNPAAVCLLEEEKDDKWLQSVAAEFNLSETCYLIPLIEPANTNPRFGLRWFTPVDEVDLCGHATLAAAHFLFSYGLVKTDTIEFSTRSGILIAKKVPEPKVSNSQDDWPTGYSIELDFPVVQVAETNFNDVLAISKSLNGASVVEIYETSMGDHFILLPSGEEVVECQPQIDLIQNCPGRGIIITGPAPQGSGFDFYSRFFCPKFGINEDPVCGSAHCALAPYWRKKLGKCDFVALAASPRGGVVKLHLDDEKQRVCLRGKAVAVMEGSLLV

SEQ ID NO: 2751 - protein, 332 aa, Solanum lycopersicum
MAKDPVRVLVTGAAGQIGYALVPMIARGVMLGADQPVILHMLDIPPAAEALNGVKMELVDAAFPLLKGVVATTDAVEACTGVNVAVMVGGFPRKEGMERKDVMSKNVSIYKSQASALEKHAAPNCKVLVVANPANTNALILKEFAPSIPEKNITCLTRLDHNRALGQISERLSVQVSDVKNVIIWGNHSSSQYPDVNHATVSTPAGDKPVRELVADDAWLNGEFISTVQQRGAAIIKARKLSSALSAASSACDHIRDWVLGTPEGTFVSMGVYSDGSYNVPAGLIYSFPVTCKNGEWSIVQGLPIDEFSRKKLDLTAEELSEEKALAYSCLA

SEQ ID NO: 2752 - protein, 321 aa, Solanum lycopersicum
MASIKSVKVPTIDFSNYQELKPNTPLWESTKIQVFEAFQEYGCFEAIYDKVPNEIREETFDMSKEIFEFPLDTKVKNISEKPMHGYMGMIPQLPLYESLCIPDLLNPQSLQNFANIFWPQGNQHFCNLVKSYSNPLVELDEILKRMISENLRLKIHIDELLNANYFLFRFTHYKGSSITGGDENNKVAGLGGHTDGNFLTFISQNQVNGLQINKNGEWIDVNISPNSYVVLAGDSFKAWTNGRLHSPLHRVTMSGENDRLSIQLFSLSKPGHFIEAPKELVDEEHPLLFKPFEIIGLFEYGTTEAGYTAPPSDLLKSYCGV

SEQ ID NO: 2753 - protein, 344 aa, Solanum lycopersicum
MGCFSLLCLHNLKDWEGLEKIESDTEYFRVPGLFDKIELTKNQLGNAARPRNEEWRVMSEKMKKAEEEAYGMVVNTFEDLEKEYIEGLMNAKNKKIWTIGPVSLCNKEKQDKAERGNEAAIDEHKCLNWLDSWEQNSVLFVCLGSLSRLSTSQMVELGLGLESSRRPFIWVVRHMSDEFKNWLVEEDFEERVKGQGLLIRGWAPQVLLLSHPSIGAFLTHCGWNSSLEGITAGVAMITWPMFAEQFCNERLIVDVLKTGVRSGIERQVMFGEEEKLGTQVSKDDIKKVIEQVMDEEMEGEMRRKRAKELGEKAKRAMEEEGSSHFNLTQLIQDVTEQAKILKPM

SEQ ID NO: 2754 - protein, 395 aa, Solanum lycopersicum
MASSSLVKLNASSSSWIGQQSFNQRSGSSCRLPVSNRRVSVIRAAGSYTDELIKTAKTIASPGRGILAIDESNATAGKRLASIGLDNTEANRQAYRQLLLTTPGLGDYISGSILFEETLFQSTTDGKKFVDVLRDQKIVPGIKVDKGLVPLPGSNNESWCQGLDGLASRSAEYYKQGARFAKWRTVVSIPCGPSALAVKEAAWGLARYAAISQDNGLVPIVEPEILLDGDHPIERTLEVAERVWAEVFYYLAENNVVFEGILLKPSMVTPGAEHKEKATPETIAKYTLTMLRRRVPPAVPGIMFLSGGQSEVEATLNLHEMNQSPNPWHVSFSYARALQNTVLKTWQGRPENVDAAQRALLIRAKANSLAQLGKYSAEGESEEAKKGMFVKGYTY

SEQ ID NO: 2755 - protein, 650 aa, Solanum lycopersicum
MAGKGEGPAIGIDLGTTYSCVGVWQHDRVEIIANDQGNRTTPSYVGFTDTERLIGDAAKNQVALNPINTVFDAKRLIGRRFSDASVQEDMKLWPFKVIPGPGDKPMIVVTYKGEEKEFAAEEISSMVLTKMKEIAEAFLGSTVKNAVVTVPAYFNDSQRQATKDAGVISGLNVMRIINEPTAAAIAYGLDKKATSAGEKNVLIFDLGGGTFDVSLLTIEEGIFEVKATAGDTHLGGEDFDNRMVNHFVHEFKRKHKKDITGNPRALRRLRTACERAKRTLSSTAQTTIEIDSLYEGVDFYSTITRARFEELNMDLFRKCMEPVEKCLRDAKMDKSTVHDVVLVGGSTRIPKVQQVAMTNFFNGKELCKSINPDEAVAYGAAVQAAILSGEGNEKVQDLLLLDVTPLSLGLETAGGVMTVLIPRNTTIPTKKEQVFSTYSDNQPGVLIQVFEGERRARTRDNNLLGKFELSVIPPAPRVVPQITVCFDIDANGILNVSAEDKTTGQKNKITITNDKGRLSKEEIEKMVQEAEKYKAEDEELKKKVEAKNSLENYAYNMRNTVKDEKIGSKLSSDDKKKIEDAVDQAISWLESNQLAEVDEFEDKMKELEGICNPIIAKMYQGAGGDAGVPMDDDAPPSGGSSAGPKIEEVD

SEQ ID NO: 2756 - protein, 704 aa, Solanum lycopersicum
MGRISVDEEGDDRVESSSGNLSSGIQASLPGRYATALFDIAREAKTIEAVEASLANVRAALDGSPDFARLVASPLVSRGDAAKAVAATAATLSLDPVTTKFLGVLADNRRLPQLRAIIAAFRALAAHYRGETTAEVSSAHPLGDDQVDALKASLRQRVGRDVAVDLSVDPSLLGGLVVRIRSQMIDSSIRTRLNSLAQAMKEISKVIKDQIANFGTEAEVSETGQVLSVGDGIARIYGLDNVQAGEMVEFSNGVQGMALNLEADNVGVVIFGSDSQIREGDVVKRTGTIVDVPVGKGLLGRVVDGLGNPIDGKGPIVTDQRSRVEVKAPGIIPRTSVHEPVQTGLKAIDALVPVGRGQRELIIGDRQTGKSAVAIDTFINQKTINAGDDESKKLYCVYVAIGQKRSTVAQLVRTLTENGAMDYSIVVAATASDPAPLQFLAPYTGCAMGEYFRDNGMHALIVYDDLSKQAVAYRQMSLLLRRPPGREAYPGDVFYLHSRLLERAAKMNSDNGSGSLTALPIIETQAGDVSAYIPTNVISITDGQIFLETDLFFAGIRPAINVGLSVSRVGSAAQTKAMKKVSGSIKLELAQYREMAAFAQFGSDLDASTQKLLNRGARLTELLKQAQFSPMPFEEQTVSIFAGTNGYIDAVPVADVTRYEGAMLAHMRSAHAAILADIRDKRELTKETTDALKDALAAFAKTFA

SEQ ID NO: 2757 - protein, 765 aa, Solanum lycopersicum
MASHVVGYPRMGPKRELKFALESFWDGKSSAEDLKKVSADLRSSIWKQMCDTGIKYIPSNTFSYYDQVLDTTAMLGAVPSRYNWTGGEIEFATYFSMARGNASVPAMEMTKWFDTNYHFIVPELGPDVNFSYASHKAVNEYKEAKAQGVDTVPVLVGPVSYLLLSKPAKGVDKSFPLLSLLDKILPIYKEVIAELKAAGASWIQLDEPTLVLDLESHKLEAFTKAYADLESSLSGLNVLVETYFADVPAEAFKTLTALKGVTAFGFDLVRGTQTLELIKSSFPSGKYLFAGVVDGRNIWANDLAASLALLQTLEGVVGKDKLVASTSCSLLHTAVDLINETKLDDEIKSWLAFAAQKVVEVNALAKALSGAKDEAFFSANAAAQASRKSSPRVTNEAVQKASAALQGSDHRRATNVSARLDAQQKKLNLPILPTTTIGSFPQTVELRRVRREYKAKKISEEEYVKAITEEIKKVVDLQEELDIDVLVHGEPERNDMVEYFGEQLSGFAFTANGWVQSYGSRCVKPPIIYGDVSRPKPMTVFWSSKAQEMTKRPMKGMLTGPVTILNWSFVRNDQPRFETCYQIALAIKDEVEDLEKAGITVIQIDEAALREGLPLRKAEHAFYLNWAVHSFRITNVGIQDTTQIHTHMCYSNFNDIIHSIIDMDADVITIENSRSDEKLLSVFREGVKYGAGIGPGVYDIHSPRIPSTEEIADRVNKMLAVLDTNILWVNPDCGLKTRKYTEVKPALQNMVSAAKTIRTQLASAK

SEQ ID NO: 2758 - protein, 981 aa, Solanum lycopersicum
MYVSSSVHIKPNFFTSFPVSKSLSKSTGAYCSSGYSSLSFSSTFRSLRWRYGVDWKSPISLTSQIRTAAVTPVLNNFRRKLTTMASGNPFKGILTSLPKPGGGEFGKYYSLPALNDPRIDKLPYSIRILLESAIRNCDNFQVKKEDVEKIIDWENTSPKLAEIPFKPARVLLQDFTGVPAVVDLACMRDAMNKLGSNADKINPLVPVDLVIDHSVQVDVARSENAVQANMELEFQRNKERFAFLKWGSNAFRNMLVVPPGSGIVHQVNLEYLGRVVFNREGLLYPDSVVGTDSHTTMIDGLGVAGWGVGGIEAEATMLGQPMSMVLPGVVGFKLSGKLRSGVTATDLVLTVTQMLRKHGVVGKFVEFYGDGMGELSLADRATIANMSPEYGATMGFFPVDHVTLQYLKLTGRSDETVSMIEAYLRANNMFVDYNEPQHEKVYSSCLYLDLAEVEPCVSGPKRPHDRVPLKEMKSDWHSCLDNKVGFKGFAVPKDAQEKVVKFSFHGQHAELKHGSVVIAAITSCTNTSNPSVMLGAALVAKKACDLGLNVKPWVKTSLAPGSGVVTKYLLQSGLQKYLNEQGFNIVGYGCTTCIGNSGDLDESVSSAISENDIVAAAVLSGNRNFEGRVHPLTRANYLASPPLVVAYALAGTVDIDFDKEPIGVGKDGNSVYFRDIWPSTEEIAEVVQSSVLPDMFKSTYEAITKGNNMWNQLSVPATSLYSWDTSSTYIHEPPYFKDMTMDPPGPHGVKDAYCLLNFGDSITTDHISPAGSIHKDSPAAKYLNERGVDRRDFNSYGSRRGNDEIMARGTFANIRIVNKLLNGEVGPKTIHIPSGEKLSVFDAAMKYKSAGQDTIILAGAEYGSGSSRDWAAKGPMLLGVKAVIAKSFERIHRSNLVGMGIVPLCFKAGEDADSLGLTGHERYTIDLPDNISEIRPGQDVTVQTDTGKSFTCVVRFDTEVELAYFNHGGILPYVIRQLSQQ

SEQ ID NO: 2759 - protein, 136 aa, Solanum lycopersicum
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 2760 - protein, 268 aa, Solanum lycopersicum
MLPYLLLLILAHAGWVTTADLGNYSLVKNIFILAGQSNISGRGGVINHSLRPGVVNESWDGVIPRECESNPSILRLSGGLKWVEAHEPLHKDIDVNNTCGIGPGMPFANTVLKKDPSIGVIGLVPCAVGGTSITEWAPGGFLYRSMIKRTKAATRGGGKIRALLWFQGESDTKTLEDAKMYKVRLERFFNHVRHDLGMPNLTVIQVGIATALGPYMELVREAQREINIGNLKYVDAKGLQIGPDYTHLTTAAQIQLGQMLADAFLRPN

SEQ ID NO: 2761 - protein, 300 aa, Solanum lycopersicum
MVKTVSFSGILSNKAKFNPDFYNWNRIRIRYCDGSSFTGDVAAADPRTKVFYRGARIFSAVMDDFLAKGMKNAQNAILAGCSAGSLAAILHCDRFKGLLPSGAKVKCLSDAGFFINTQTISGTSHIEKFYSEVVNTHGSAKNLPQSCTSRLKPGLCFFPQNVAQQIQTPLFLVNAAYDSWQIKNILAPGVADPHGTWRNCKLDILKCSSAQLQTMQAFRSEFLKALNSLGPSSTRGYYINSCYAHCQTGTQETWLRDDSPVLSGTTIAKAVGDWYYERKRFQEIDCPYPCNKTCKNRNFE

SEQ ID NO: 2762 - protein, 329 aa, Solanum lycopersicum
MRLYAYSLLFSLLLLTVSAEQCGRQAGGARCAAGLCCSNFGWCGNTNDYCGPGKCQSQCPSGPSPKPPTPGPGPSGGDISSVISNSMFDQMLKHRNENSCQGKNNFYSYNAFINAARSFRGFGTTGDNTARKREIAAFFAQTSHETTGGWPSAPDGPYAWGYCFLREQGSPGDYCTPSSQWPCAPGRKYFGRGPIQISHNYNYGPCGRAIGADLLNNPDLVATDPVISFKSAIWFWMTPQSPKPSCHDVITGRWQPSGADRAANRLPGFGVITNIINGGLECGRGSDSRVQDRIGFYRRYCGILGVSPGDNLDCGNQRSFGNGLLVDTM

SEQ ID NO: 2763 - protein, 364 aa, Solanum lycopersicum
MGFRLSHLSLALSFVALALAGVAIYRNTYEAIIMKNGSLLKNVSPDFDSLESGVASILTLNNNKKRNSDKYLRQQLTPEACVFSAVRAVVDSAIDAETRMGASLIRLHFHDCFVDGCDGGILLDDINGTFTGEQNSPPNANSARGYEVIAQAKQSVINTCPNVSVSCADILAIAARDSVAKLGGQTYSVALGRSDARTANFSGAINQLPAPFDNLTVQIQKFSDKNFTLREMVALAGAHTVGFARCSTVCTSGNVNPAAQLQCNCSATLTDSDLQQLDTTPTMFDKVYYDNLNSNQGIMFSDQVLTGDATTAGFVTDYSNDVNVFLGDFAAAMIKMGDLPPSAGAQLEIRDVCSRVNPTSVASM

SEQ ID NO: 2764 - protein, 392 aa, Solanum lycopersicum
MASASLLKTSPVLDKTEFVKGQSLRLPSVSVRCQPSALTVRASSYADELVKTAKTIASPGRGILAMDESNATCGKRLASIGMENTEANRQAFRTLLVSVPGLGEYISGAILFEETLYQSTVEGKKMVDVLVEQNIVPGIKVDKGLVPLAGSNNESWCQGLDGLASRSAAYYQQGARFAKWRTVVSIPNGPSALAVKEAAWGLARYAAISQDNGLVPIVEPEILLDGEHNIDRTFEVAKQVWAEVFFYLAQNNVMFEGILLKPSMVTPGAECKDRATPQQVADYTLSLLRQRIPPAVPGIMFLSGGQSEVEATLNLNAMNQSPNPWHVSFSYARALQNTCLKTWSGRPENVKAAQDALLVRAKANSLAQLGKYTGEGESDEAKKGMFVKGYVY

SEQ ID NO: 2765 - protein, 401 aa, Solanum lycopersicum
MAVKKSVGSLKEADLKGKRVFVRVDLNVPLDDNFKITDDTRIRAAVPTIKYLMQNGARVILASHLGRPKGVTPKYSLKPLVPRLSELLGIEVKMANDSVGPEVENLVAGLPEGGVVLLENVRFYKEEEKNDPEFAKKLASLADLYVNDAFGTAHRAHASTEGVAKVLKPAVAGFLMQKELDYLVGAVSNPQKPFAAIVGGSKVSSKIGVIESLLEKVDVLLLGGGMIFTFYKAQGYAVGSSLVEEDKLDLATSLMEKAKTKGVSLLLPTDVVIADKFAADANSKIVPASEIPDGWMGLDIGPDAIKSFGSALDTTKTIIWNGPMGVFEFDKFAAGTEAIAKKLAELSGKGVTTIIGGGDSVAAVEKVGLAEKMSHISTGGGASLELLEGKQLPGVLALDDA

SEQ ID NO: 2766 - protein, 389 aa, Solanum lycopersicum
MSHRKFEHPRHGSLGFLPRKRAARHRGKVKAFPKDDPSKPCKLTAFLGYKAGMTHIVREVEKPGSKLHKKETCEAVTIVETPPMVIVGVVGYVKTPRGLRCLNTVWAQHLSEDIKRRFYKNWCKSKKKAFLKYSKKYETDEGKKDIQAQLEKLKKYACVIRVLAHTQIRKMKGLKQKKAHLMEIQVNGGSIAQKVDFAYGFFEKQVPVDAVFQKDEMIDIIGVTKGKGYEGVVTRWGVTRLPRKTHRGLRKVACIGAWHPARVSFTVARAGQNGYHHRTEMNKKVYKLGKVGQESHTALTEFDRTEKDITPIGGFPHYGVVKEDYLLIKGCCVGTKKRVVTLRQSLLNQTSRVALEEIKLKFIDTSSKFGHGRFQTTQEKQKFYGRLKA

SEQ ID NO: 2767 - protein, 413 aa, Solanum lycopersicum
MARLAPEGAQFDARQFDSKMNDLLAAEGKDFFTSYDEVYDSFDAMGLQENLLRGIYAYGFEKPSAIQQRGIVPFCKGLDVIQQAQSGTGKTATFCSGILQQLDYGLIQCQSLVLAPTRELAQQIEKVMRALGDYLGVKVHACVGGTSVREDQRILAAGVHVVVGTPGRVFDMLRRQSLRPDCLRMFVLDEADEMLSRGFKDQIYDIFQMLPTKVQVGVFSATMPPEALDITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTTDDERMLFDIQKFYNVVIEELPSNVADLL

SEQ ID NO: 2768 - protein, 444 aa, Solanum lycopersicum
MATIKSIKARQIFDSRGNPTVEVDVHISNGVFARAAVPSGASTGIYEALELRDGGSDYLGKGVSKAVNNVNSIIGPALVGKDPTDQTGLDNFMVHQLDGTQNEWGWCKEKLGANAILAVSLAVCKAGAAVRNVPLYKHIADLAGNKKLVLPVPAFNVINGGSHAGNKLAMQEFMILPVGAANFKEAMKMGCEVYHHLKAVIKKKYGQDATNVGDEGGFAPNIQENKEGLELLKTAIEKAGYTGKVVIGMDVAASEFYGKDKSYDLNFKEESNDGSQKISGDQLKDLYKSFVSEYPIVSIEDPFDQDDWETYAKLTAEIGEQVQIVGDDLLVTNPKRVAKAIAEKTCNALLLKVNQIGSVTESIEAVKMSKKAGWGVMTSHRSGETEDTFIADLAVGLSTGQIKTGAPCRSERLAKYNQLLRIEEELGSEAVYAGASFRKPVEPY

SEQ ID NO: 2769 - protein, 666 aa, Solanum lycopersicum
MAACSRRGNSLVVLAIVLLGCLSALSNAKEEATKLGTVIGIDLGTTYSCVGVYKNGHVEIIANDQGNRITPSWVAFTDNERLIGEAAKNLAAVNPERTIFDVKRLIGRKFEDKEVQRDMKLVPYKIVSKDGKPYIQVKIKDGEVKVFSPEEISAMILTKMKETAEAFLGKTIKDAVVTVPAYFNDAQRQATKDAGVIAGLNVARIINEPTAAAIAYGLDKKGGEKNILVFDLGGGTFDVSILTIDNGVFEVLATNGDTHLGGEDFDQRIMEYFIKLIKKKHGKDISKDNRALGKLRREAERAKRSLSSQHQVRVEIESLFDGTDFSEPLTRARFEELNNDLFRKTMGPVKKAMDDAGLQKNQIDEIVLVGGSTRIPKVQQLLKDYFDGKEPSKGVNPDEAVAYGAAVQGGILSGEGGDETKDILLLDVAPLTLGIETVGGVMTKFIPRNTVIPTKKSQVFTTYQDQQTTVSIQVFEGERSLTKDCRNLGKFDLTGIPPAPRGTPQIEVTFEVDANGILNVKAEDKGTGKAEKITITNDKGRLSQEEIERMVREAEEFAEEDKKVKEKIDARNALETYVYNMKNQINDKDKLADKLESDEKEKIETATKEALEWLDDNQSAEKEDYDEKLKEVEAVCNPIITAVYQRSGGAPGGGASEEEDDSHDEL

SEQ ID NO: 2770 - protein, 699 aa, Solanum lycopersicum
MAEAETFAFQAEINQLLSLIINTFYSNKEIFLRELISNSSDALDKIRFESLTDKSKLDAQPELFIRLVPDKANKTLSIIDSGVGMTKADLVNNLGTIARSGTKEFMEALQAGADVSMIGQFGVGFYSAYLVAEKVIVTTKHNDDEQYVWESQAGGSFTVTRDVSGEQLGRGTKITLFLKEDQLEYLEERRIKDLVKKHSEFISYPIYLWTEKTTEKEISDDEDDEPKKDEEGAVEEVDEDKEKEKGKKKKIKEVSHEWQLINKQKPIWLRKPEEITKEEYASFYKSLTNDWEDHLAVKHFSVEGQLEFKAILFVPKRAPFDLFDSRKKMNNIKLYVRRVFIMDNCEELMPEYLGFVKGVVDSDDLPLNISREMLQQNKILKVIRKNLVKKCIEMFNEIAENKEDYNKFYEAFSKNLKLGIHEDSQNRAKLADLLRYHSTKSGDELTSLKDYVTRMKEGQKDIYYITGESKKAVENSPFLERLKKKGYEVLYMVDAIDEYAVGQLKEYDGKKLVSATKEGLKLDDDSEEEKKKKEEKKKSFENLCKIIKDILGDKVEKVVVSDRIVDSPCCLVTGEYGWTANMERIMKAQALRDTSMSSYMSSKKTMEINPDNGIMEELRKRAEADQNDKSVKDLVLLLFETALLTSGFSLDDPNTFAARIHRMLKLGLSIEEEEEGAGEDADMPALEEIGEESKMEEVD

SEQ ID NO: 2771 - protein, 844 aa, Solanum lycopersicum
MEINFNVLSKPIRGSFPFSSPRVSPRASRTKICFPSQHSTGLKFGSEGRSWDISSTPKSRVRKDERMKHSSAISAVLTNDNSTMASREEDVKTENIGLLNLDPALEPYLDHFRYRMKRYVDQKMLIQKYEGGLEEFAQGYLKFGFNREDGCIVYREWAPAAQEAEVIGDFNGWNGSNHMMEKDQFGVWSIRIPDVDSKPAIPHNSRVKFRFKHGEGAWVDRIPAWIKYATVDATKFAAPYDGVYWDPPPSERYNFKYPRPSKPRAPRIYEAHVGMSSSEPRVNSYREFADDVLPRIKANNYNTVQLMAIMEHSYYGSFGYHVTNFFAVSSRSGNPEDLKYLIDKAHSLGLQVLVDVVHSHASNNVTDGLNGFDIGQGSQESYFHAGERGYHKLWDSRLFNYANWEVLRFLLSNLRWWLEEYNFDGFRFDGITSMLYVHHGINMGFTGNYNEYFSEATDVDAVVYLMLANNLIHKIFPDATVIAEDVSGMPGLGRHVSEGGIGFDYRLAMAIPDKWIDYVKNKNDEDWSMKEVTSSLTNRRYTEKCIAYAESHDQSIVGDKTIAFLLMDKEMYSGMSCLTDASPVVDRGIALHKMIHFFTMALGGEGYLNFMGNEFGHPEWIDFPREGNNWSYDKCRRQWNLADSQHLRYKFMNAFDRAMNSLDEKFSFLASGKQIVSSIDDDNKVVVFERGDLVFVFNFHPNNTYEGYKVGCDLPGKYRVALDSDAWEFGGHGRVGHDVDHFTSPEGIPGVPETNFNGRPNSFKLLSPAHTCVAYYRVDECMSETEVYQTDISNELLPTANIEESDEKLKDSLSTNISNIGQTVVASVEERDKELKDSPICKHH

SEQ ID NO: 2772 - protein, 76 aa, Solanum lycopersicum; identical to SEQ ID NO: 526

SEQ ID NO: 2773 - protein, 175 aa, Solanum lycopersicum
MADVEYRCFVGGLAWATTDQTLSEAFSQYGEVVESKIINDRETGRSRGFGFVTFKDEQAMRDAIEGMNGQDLDGRNITVNEAQSRGGGGGGGGRGGGGYGGGRREGGGGGYGGGGGYGGGRREGGGGGYGGGGYGGGRREGGYGGGGGGYGGGDRYNDRSSRGGGGGGSDGNWRN

SEQ ID NO: 2774 - protein, 147 aa, Solanum lycopersicum
MGVKGKLIALVEVKCGGHPILDFFHIHTHHIPNISPNIINHLEIHAGETVKVGSIVSCNYNEAGQKKSAKQVIEAIDLDKKSITWKVIEGDVLESYSSFTGILSCEHEWTTWTIEYEKKTEDIPEPLIQLGLLLDLTKDIERHLFKK

SEQ ID NO: 2775 - protein, 160 aa, Solanum lycopersicum
MGVNTFTHESTTTIAPTRLFKGLVLDFDSLVPKLLSHDVKSIEIVEGDGGAGSIKQMNFVEGGPIKYLKHKIHVIDDKNLVTKYSLIEGDVLGDKLESIAYDVKFEAAGDGGCVCKTTTEYHTKGDHVVSEEEHNVGKGKAIDLFKAIEAYLLANPSVYA

SEQ ID NO: 2776 - protein, 179 aa, Solanum lycopersicum
MTSLHFLTAVAFTFFLTAHIAAAGSSEECVYTLYVRTGSIIKGGTDSKISVTLGDASGKSVWIPDLEKWGLMGPNYDYYERGNVDIFTGRGKCISTPICRLNVTSDGSGDHHGWFLDYVETTFTGPHMQCSQSIFYVDQWLASDAPPYELSVSLDGCKKKIGNHGRRFVVGKPIRSASE

SEQ ID NO: 2777 - protein, 197 aa, Solanum lycopersicum
MVHVSFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVASFMVRVDSQKHIDFSLTSPFGGGRPGRVKRKNQKSAAKKAAGGDGDEEDEE

SEQ ID NO: 2778 - protein, 204 aa, Solanum lycopersicum
MGAYTYVSELWRKKQSDVMRFLQRVRCWEYRQLPSIVRVTRPTRPDKARRLGYKAKQGYVVYRVRVKRGGRKRPVSKGIVYGKPTNQGVTQLKFQRSKRSVAEERAGRKLGGLRVLNSYWINEDSTYKYFEVILVDQAHAGIRNDPRINWICNPVHKHRELRGLTSAGKKYRGLRGRGHLHHKARPSRRATWKRNQTLSLRRYR

SEQ ID NO: 2779 - protein, 213 aa, Solanum lycopersicum
MVSLKLQKRLAASVLKCGRGKVWLDPNEGNEISMANSRQNIRKLVKDGFIIRKPTKIHSRSRARRMKEAKRKGRHSGYGKRKGTREARLPTKVLWMRRLRVLRRLLRKYRESKKIDKHMYHDMYMKVKGNVFKNKRVLMENIHKTKAEKAREKTLSDQFEARRAKNKASRERKFARREERLAQGPGGEKPVQPAAPAAAAPAQPAQGSKKSKK

SEQ ID NO: 2780 - protein, 247 aa, Solanum lycopersicum
MGYLTSSFVLFFLLCVTYTYAATIEVRNNCPYTVWAASTPIGGGRRLNRGQTWVINAPRGTKMARIWGRTGCNFNAAGRGTCQTGDCGGVLQCTGWGKPPNTLAEYALDQFSNLDFWDISLVDGFNIPMTFAPTKPSGGKCHAIHCTANINGECPRALKVPGGCNNPCTTFGGQQYCCTQGPCGPTELSKFFKKRCPDAYSYPQDDPTSTFTCPGGSTNYRVVFCPNGVADPNFPLEMPASTDEVAK

SEQ ID NO: 2781 - protein, 255 aa, Solanum lycopersicum
MASPREENVYMANVADEAERYEEMVEFMEKVVAALNGEELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSDMQDDGTDEIKEPSKADNE

SEQ ID NO: 2782 - protein, 271 aa, Solanum lycopersicum
MATEEPVVAIEPVNEPMVVAEPATEENPPAETDEPKKEKEIKAKKSSAPRKRNPPTHPSYFEMIKEAIVTLKDKTGSSQYAITKFIEDKQKNLPSNFRKMLLAQLKKLVASGKLVKVKSSYKLPAPKAAAPALAKKKSIAKPKAAQAKKATKAKPKPKPKVAAPKAKTATKSKAKPKPVVAAKAKPAAKPKAVVAKPKAAVKPKAPVKAKAAVKPKAANEKPAKVARTSTRSTPSRKAAPKPAVKKAPVKSVKSKTVKSPAKKASARKAKK

SEQ ID NO: 2783 - protein, 287 aa, Solanum lycopersicum
MATEEPVIVNEVVEEQAAPETVKDEANPPAKSGKAKKETKAKKPAAPRKRSATPTHPPYFEMIKDAIVTLKERTGSSQHAITKFIEEKQKSLPSNFKKLLLTQLKKFVASEKLVKVKNSYKLPSGSKPAAAAVPAKKKPAAAKSKPAAKPKAAVKPKAKPAAKAKPAAKAKPAAKAKPAAKAKPAAKAKPAAKAKPVAKAKPKAAAAAKPKAAVKPKAAPAKTKAAVKPNLKAKTTTAKVAKTATRTTPSRKAAPKATPAKKEPVKKAPAKNVKSPAKKATPKRGRK

SEQ ID NO: 2784 - protein, 286 aa, Solanum lycopersicum
MAENKEEDVKLGANKFRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYMVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGINPARSLGAAIIYNDEHAWNDHWIFWVGPMIGAALAAIYHQIIIRAMPFHRS

SEQ ID NO: 2785 - protein, 287 aa, Solanum lycopersicum
MTKEVEAVHEQAVEYSAKDYTDPPPAPLIDFEELTKWSLYRAAIAEFIATLLFLYITILTVIGYKHQADVKAGGDICGGVGLLGIAWAFGGMIFVLVYCTAGISGGHINPAVTFGLFLARKVSLIRAILYMVAQCLGAICGVGFVKAFQSAYYNRYGGGVNVMAGGHTKGVGLAAEIIGTFVLVYVVFSATDPKRSARDSHVPVLAPLPIGFAVFMVHLATIPITGTGINPARSFGAAVIFNGDKAWDEHWIFWVGPFIGAFIAAVYHQYILRAGAIKALGSFRSNA

SEQ ID NO: 2786 - protein, 355 aa, Solanum lycopersicum
MGKGGSDENMAAWLLGVNTLKIQPFNLPALGPHDVRVRMKAVGICGSDVHYLKTMRCADFVVKEPMVIGHECAGIIEEVGGEVKTLVPGDRVALEPGISCWRCNLCKEGRYNLCPEMKFFATPPVHGSLANQVVHPADLCFKLPDDISLEEGAMCEPLSVGVHACRRANVGPETNILVLGAGPIGLVTLLAARAFGAPRIVIVDVDDYRLSVAKKLGADDIVKVSINIQDVATDIENIQKAMGGGIDASFDCAGFNKTMSTALGATRPGGKVCLVGMGHHEMTVPLTPAAAREVDVIGIFRYKNTWPLCLEFLRSGKIDVKPLITHRFGFSQEEVEEAFETSARGGDAIKVMFNL

SEQ ID NO: 2787 - protein, 380 aa, Solanum lycopersicum
MSTTVGQVIRCKAAVAWEAGKPLVMEEVDVAPPQKMEVRLKILYTSLCHTDVYFWEAKGQNPVFPRILGHEAAGIVESVGEGVTDLAPGDHVLPVFTGECKDCAHCKSEESNMCSLLRINTDRGVMLNDGKSRFSINGNPIYHFVGTSTFSEYTVVHVGCVAKINPLAPLDKVCVLSCGISTGLGASLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPLNFLNERTLKGTFFGNYKPRSDIPCVVEKYMNKELELEKFITHTLPFAEINKAFDLMLKGEGLRCIITMAD

SEQ ID NO: 2788 - protein, 371 aa, Solanum lycopersicum
MKSSIKVLLLLVLLCAISSISIAVIDGLLKNGNFEMPPSKADLNGTEVLKHNAIPEWSISGFVEYIKAGQKQGDMLLVVPEGYAAVRLGNEASIKQILNVTKGMYYSLTFSAARTCAQEERINVSVTPDFGVLPIQTLYSSSGWDSYAWAFQAEFPQVEILLHNPGVEEDPACGPLIDSIAIRTLYPPRATNQNLLKNGDFEEGPYVFPNTSWGVLVPPNIEDDHSPLPAWMVESLKAVKYLDSDHFSVPHGKRAIELVAGKESAIAQVARTTIGKMYQLSFKVGDASNACEGSMIVEAFAGRDTLKVPYESMGKGGYKRAILRFKATASRTRIMFLSTYYHTRSDDFVSLCGPVVDDVTLLSVRTHRRVL

SEQ ID NO: 2789 - protein, 415 aa, Solanum lycopersicum
MAFQKIIVQNPIVEMDGDEMTRVIWKSIKDKLILPFLELDIKYFDLGLPHRDATDDKVTIESAEATQKYNVAIKCATITPDEARVKEFNLKSMWRSPNGTIRNILNGTVFREPIMCKNIPRLVPGWTKPICIGRHAFGDQYRATDTVIKGAGKLKLVFVPEGSDEKTEFEVYNFTGAGGVALSMYNTDESVRAFAEASMNMAFQKKWPLYLSTKNTILKKYDGRFKDIFQEVYEANWKSKYEEAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRATLDNNERLLDFTEKLEAACIGAVESGKMTKDLALIIHGSKLSREHYLNTEEFIDAVADELKAKLLKAKA

SEQ ID NO: 2790 - protein, 477 aa, Solanum lycopersicum
MSPVPALSPADAEKLANLKSAVSSLTQISDNEKSGFLNLVTRYLSGEAQHVEWSKIQTPTDDVVVPYDKLAPLSEDPAETKKLLDKLVVLKLNGGLGTTMGCTGPKSVIEVRNGLTFLDLIVKQIEDLNTKYGCTVPLLLMNSFNTHDDTAKIVEKYSNSNIEIHTFNQSQYPRMVIEDFAPLPCKGNAGKDGWNPPGHGDVFPSLMNSGKLDALLSKGKEYVFVANSDNLGAVVDLKILNHLIQNKNEYCMEVTPKTLADVKGGTLISYDGKVQLLEIAQVPDQHVNEFKSIEKFKIFNTNNLWVNLNAVKRLVEADALKMEIIPNPKEVDGIKVLQLETAAGAAIRFFDRAIGANVPRSRFLPVKASSDLLLVQSDLYTLTDDGYVIRNPARANPSNPSIELGPEFKKVASFLSRFKSIPSIIELDSLKVTGDVYFGAGITLKGNVTINAKSGVKLEIPDGAVIKNKDVNRPEDI

SEQ ID NO: 2791 - protein, 587 aa, Solanum lycopersicum
MEGNNAIGSTAQSASVPASSPCGAGTLGRHLARRLVQIGVKDVFSVPGDFNLTLLDHLIAEPELNLIGCCNELNAGYAADGYARAKGVGACVVTFTVGGLSVLNAIAGAYSENLPVICIVGGPNSNDYGTNRILHHTIGLPDFSQELRCFQTVTCSQAVVNNLDDAHELIDTAISTALKESKPVYISIGCNLPGIAHPTFAREPVPFYLAPKVSNQLGLEAAVEAAAEFLNKSVKPVIVGGPKVRVGKAQKAFVELADACGYPLAVMPSGKGLVPEHHPSFIGTYWGAVSSSFCGEIIESADAYVFVGPIFNDYSSVGYSLLIKKEKLIVVEPHRVTIGNGPSFGWVFMTDFLSALAKKLKKNSTALENHHRIYVPPGVALKREKDELLRVNILFKHIQEMLSGNTAVIAETGDSWFNCQKLNLPENCGFEFQMQYGSIGWSVGATLGYAQAAKDKRIIACIGDGSFQVTAQDISTMIRCAQKNIIFLINNGGYTIEVEIHDGPYNVIKNWDYTGLVNAIHNGEGKCWTAKVKTEEDLTEAIATATSTHKDSLCFIEVFVHKDDTSKELLEWGSRVSAANSRPPNPQ

SEQ ID NO: 2792 - protein, 589 aa, Solanum lycopersicum
MAEETKKPASDETTPPTTVADVPVPEKESTPQPEPVPVPETPEKSADPVTEETDKEKTPVTESASFKEESNKVDELPNPEQKALAELKELVQDALNKHEFTAPPVKEEEKKPEAEAVAIAVAEEEKKEESAAEEPTTDAAPATTEPVKEEPPVPAAVVEEKKETTPVVEEKKEVPPVVEEKKETPASADPSETVEKVTEKVTADEEDGSKAVEEIKETIVEVTATSTAPVEEDAAVPAEEVAATEEEVSIWGIPLLADERSDVILLKFLRARDFKVKEAFAMLKSVVAWRKEFNIDELLEEDLSGLGLEKVVYNHGVDKEGHPVCYNAFGAFQDNELYQNTFADKEKMDKFLRWRIQFMEKSIRNLDFSPDGICTFVQVIDLKNSPGLYLYKKELRQATNRALQLLQDNYPEFVAKQVFINVPWWYPAYYRMINALFTTRTKSKFVFAGASRSAETLFKYIVPEQVPVQYGGLSREGEQEFTIADSATEDTVKPASKHTVEFPVTEKSNLVWEARVVGWDVCYGAEFVPSAEGGYTIIVEKSRKIAAANETVITNNYTAPEAGKVVLTFDNQTSKRKKLVYRSKTKSSD

SEQ ID NO: 2793 - protein, 623 aa, Solanum lycopersicum
MPSLFGGPLTTFEDSEKESEYGYVRKVSGPVVVADGMAGAAMYELVRVGHDNLIGEIIRLEGDSATIQVYEETAGLMVNDPVLRTRKPLSVELGPGILGNIFDGIQRPLKTIAKRSGDVYIPRGVSVPALDKDILWEFEPKKIGEGDILTGGDLYANVFENSLMEHHVALPPDAMGKITYIAPAGHYSLKDTVLELEFQGVKKQFTMLQSWPVRTPRPVAAKLAADTPLLTGQRVLDALFPSVLGGTCAIPGAFGCGKTVISQALSKYSNSDTVVYVGCGERGNEMAEVLMDFPQLTMTLPDGREESVMKRTTLVANTSNMPVAAREASIYTGITIAEYFRDMGYNVSMMADSTSRWAEALREISGRLAEMPADSGYPAYLAARLASFYERAGKVKCLGGPERNGSVTIVGAVSPPGGDFSDPVTSATLGIVQVFWGLDKKLAQRKHFPSVNWLISYSKYSGALESFYEKFDPDFINIRTKAREVLQREDDLNEIVQLVGKDALAETDKITLETAKLLREDYLAQNAFTPYDKFCPFYKSVWMLRNIIHFYNLANQAVERGAGMDGQKMTYTLIKHRLGDLFYRLVSQKFEDPAEGEDALVAKFKKLHDDLTAGFRNLEDETR

SEQ ID NO: 2794 - protein, 911 aa, Solanum lycopersicum
MNPEKFTHKTNEAIAEAHELAVSAGHAQLTPLHMALALLSDHSGIFWQAIVNAAGSEETANGVERVFNQAKKKIPSQSPAPDQVPASTSLIKVLRRAQSLQKSRGDSHLAVDLLILGLLEDSQIADLLKDSGLSAARVKSEVEKLRGKDGKKVESATGDTTFQALKTYGRDLVEQAGKLDPVIGRDEEIRRVIRILSRRTKNNPVLIGEPGVGKTAVVEGLAQRIVRGDVPSNLADVRLIALDMGALIAGAKYRGEFEERLKAVLKEVEDAEGKVILFIDEIHLVLGAGRTEGSMDAANLFKPMLARGQLRCIGATTLEEYRKYVEKDAAFERRFQQVYVAEPSVPDTISILRGLKEKYEGHHGVKIQDRALVIAAQLSARYITGRHLPDKAIDLVDEACANVRVQLDSQPEEIDNLERKRIQLEVEHHALEKEKDKASKARLVEVRKELDDLRDKLQPLMMRYKKEKERVDELRRLKQKRDELTYALQEAERRYDLARAADLRYGAIQEVESAIANLESSTDESTMLTETVGPDQIAEVVSRWTGIPVSRLGQNEKEKLIGLADRLHLRVVGQDQAVKAVAEAVLRSRAGLGRPQQPTGSFLFLGPTGVGKTELAKALAEQLFDDDKLMVRIDMSEYMEQHSVARLIGAPPGYVGHEEGGQLTEAVRRRPYSVVLFDEVEKAHPAVFNALLQVLDDGRLTDGQGRTVDFTNTVIIMTSNLGAEYLLSGLSGKCTMEKAREMVMQEVRKQFKPELLNRLDEIVVFDPLSHEQLRQVCRHQLKDVASRLAERGIALGVTEAALDVILAQSYDPVYGARPIRRWLEKKVVTELSKMLVKEEIDENSTVYIDAGRGGKDLTYRVENNGGLVNAATGQKSDVLIQLPNGPRNDAAQAVKKMRIEEIDDEDDEMAD

SEQ ID NO: 2795 - protein, 460 aa, Vitis vinifera
MILPHSFISLSFHLHFRTLSLLYIAPSHTLSLPHFIFPSLFPSLEREHPKPIVFGDWLGSLFLLRLRFSLLSVSAVFKRGNKRMADTEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 2796 - protein, 377 aa, Vitis vinifera
MAETEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDALMKILTERGYSFTTTAEREIVRDMKEKLAYIALDYEQELETAKTSSSVEKSYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 2797 - protein, 377 aa, Vitis vinifera
MADGEDVQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYMMKILTERGYSFTTTAEREIVRDMKEKLSYIALDYEQELETAKTSSSVEKSYELPDGQVITIGAERFRCPEVLFQPSFIGMEASGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 2798 - protein, 445 aa, Vitis vinifera
MATIKVIKARQIFDSRGNPTVEVDVTLSDGTFARAAVPSGASTGIYEALELRDGGSDFLGKGVLKAVENVNAIIAPALIGKDPTEQVKIDNFMVQQLDGTVNEWGWCKQKLGANAILAVSLAVCKAGAMVNKIPLYKHIANLAGNKKLVLPVPAFNVINGGSHAGNKLAMQEFMILPLGASSFKEAMKMGVEVYHHLKSVIKKKYGQDATNVGDEGGFAPNIQENKEGLELLKTAIAKAGYTGKVVIGMDVAASEFYDNKDKTYDLNFKEENNDGSQKISGDSLKNVYKSFVNDYPIVSIEDPFDQDDWEHYAKMTSEIGEKVQIVGDDLLVTNPKRVEKAIKEKACNALLLKVNQIGSVTESIEAVKMSKRAGWGVMASHRSGETEDTFIADLSVGLATGQIKTGAPCRSERLAKYNQLLRIEEELGSAAVYAGAKFRAPVEPY

SEQ ID NO: 2799 - protein, 559 aa, Vitis vinifera
MGSSGFSWKLADHPKLPKGKILGMVVLDGWGEANPDQYNCIHVADTPTMDSLKKGAPEKWRLVKAHGSAVGLPTEDDMGNSEVGHNALGAGRIYAQGAKLVDFALDSGKIYEGEGFKYIKECFETGTLHLIGLLSDGGVHSRIDQLQLLLKGASENGAKRIRVHILTDGRDVLDGSSVGFVETLENDLAKLREKGVDAQIASGGGRMYVTMDRYENDWEVVKRGWDAQVLGEAPHKFRSAVEAVKKLREDTKASDQYIPPFVIVDENGKPVGPIVDGDAVVTFNFRADRMVMIAKSLEYEDFDKFDRVRFPKIHYAGMLQYDGELKLPNHYLVSPPEIERTSGEYLVHNGVRTFACSETVKFGHVTFFWNGNRSGYFDPSMEEYVEIPSDSGITFNVKPKMKAVEIAEKARDAILSRKFHQVRVNLPNGDMVGHTGDIEATIVACKAADEAVKIILDAIEQVGGIYVVTADHGNAEDMVKRNKSGQPLLDKTGKIQILTSHTLQPVPIAIGGPGLAAGVRFRNDVPGGGLANVAATVMNLHGYEAPSDYEPTLIEVIDN

SEQ ID NO: 2800 - protein, 853 aa, Vitis vinifera
MDFNRICLPLWVKFTVEELRRIMDYKHNIRNMSVIAHVDHGKSTLTDSLVAAAGIIAQEVAGDVRMTDTRQDEAERGITIKSTGISLYYEMSDESLKNYRGERQGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVDESKMMERLWGENFFDPSTRKWTTKNTGAPNCKRGFVQFCYEPIKQIINTCMNDQKDKLWPMLQKLGVTMKSDEKDLMGKALMKRVMQTWLPASTALLEMMIFHLPSPSTAQKYRVENLYEGPLDDIYATAIRNCDPEGPLMLYVSKMIPASDKGRFFAFGRVFSGKVSTGLKVRIMGPNYVPGEKKDLYVKSVQRTVIWMGKRQETVEDVPCGNTVAMVGLDQFITKNATLTNEKESDAHPIRAMKFSVSPVVRVAVQCKVASDLPKLVEGLKRLAKSDPMVVCSIEESGEHIIAGAGELHLEICLKDLQDDFMGGAEIVKSDPVVSFRETVLEKSCRTVMSKSPNKHNRLYMEARPLEEGLAEAIDDGRVGPRDDPKARSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVVESFGFSGTLRAATSGQAFPQCVFDHWDVMSADPLEAGSTAAQLVADIRKRKGLKEQMTPLSEFEDKL

SEQ ID NO: 2801 - protein, 436 aa, Vitis vinifera
MVTIQFVKARQIFDSRGNPTVEVDIGLSNGAKVSAAVPSGASTGIYEALELRDGGSDYLGKGVSKAVANVNTIIGPALIGKDPSDQTGIDNFMVQQLDGTVNEWGWCKQKLGANAILAVSLAVCKAGAIVKNIPLYKHIANIAGNKHLVLPVPAFNVINGGSHEFMILPIGAPSFKEAMKMGVEVYHHLKAVIKKKYGQDATNVGDEGGFAPNIQENKEGLELLKTAIAKAGYTKEVVIGMDVAASEFYGTDKTYDLNFKEENNDGSEKISGDALKNLYKSFVNEYPISSIEDPFDQDDWEHYTKLTCEIGEKVQIVGDDLLVTNPKRVEKAIKEKACNALLLKVNQIGTVTESIEAVKMSKRAGWGVMASHRSGETEDTFIADLSVGLATGQIKTGAPCRSERLAKYNQLLRIEEELGADAVYAGANFRKPVEPY

SEQ ID NO: 2802 - protein, 952 aa, Vitis vinifera
MAEDLDKPLLDPENFNREGIDLERIPLEEVFEQLRTSRGGLSSEDAEARLIIFGPNKLEEKPENKFLKFLSFMWNPLSWVMEAAAVMAIVLANGGGEGPDWQDFVGILCLLIINSTISFIEENNAGNAAAALMARLAPKTKVLRDGHWQEQDAAILVPGDIISIKLGDIIPADARLLEGDPLKIDQSALTGESLPVTKRTGDEVFSGSTCKHGEIEAVVIATGVHSFFGKAAHLVDSTEVIGHFQKVLTSIGNFCICSIAVGMILEIIVMFPIQHRSYRNGINNLLVLLIGGIPIAMPTVLSVTLAIGSHRLSQQGAITKRMTAIEEMAGMDVLCSDKTGTLTLNRLTVDRNLIEVFAKDMDKDTVVLLAARASRLENQDAIDTAIINMLADPKEARANITEVHFLPFNPVDKRTAITYIDSNGNWIRASKGAPEQYPHILNLCQEKEEIAGKVHAIIDKFAERGLRSLGVAYQEVPEQTKESPGGPWTFCGLLPLFDPPRHDSAETIRRALNLGVCVKMITGDQLAIAKETGRRLGMGTNMYPSSSLLGREKDESEVLPVDELIEKADGFAGVFPEHKYEIVRILQEKKHVCGMTGDGVNDAPALKKADIGIAVADATDAARSAADIVLTEPGLSVIISAVLTSRAIFQRMKNYTIYAVSITIRIVLGFVLLALIWEYDFPPFMVLIIAILNDGTIMTISKDRVKPSPKPDSWKLNEIFATGVVIGTYLALVTVLFYWVIDSTTFFQTHFHVSTLKSTEEISSAIYLQVSIISQALIFVTRSQSWSFMERPGALLMCAFVVAQLVATLIAVYAEISFASISGIGWGWAGVIWIYSVIFYVPLDIIKFTVRYALSGEAWNLLFDRKTAFTSKKDYGKEDREAKWVLSQRTIQGLMSSELEINGRRSSLIAEQARRRAEIARLGEIHTLRGHVESVVRLKNLDINVIQAAHTV

SEQ ID NO: 2803 - protein, 485 aa, Vitis vinifera
MSLLVEKTSSGREYKVKDMSQADFGRLEIELAEVEMPGLMSCRTEFGPQQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYAKSGKLPDPSSTDNAEFQIVLTIIRDGLKTDPKRYHKMKGRLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGIPVQTIEDVVSEADIFVTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWKEKASGKYEKKVYVLPKHLDEKVAALHLGKLGAKLTKLSKDQADYISVPIEGPYKPPHYRY

SEQ ID NO: 2804 - protein, 650 aa, Vitis vinifera
MAGKGEGPAIGIDLGTTYSCVGVWQHDRVEIIANDQGNRTTPSYVAFTDTERLIGDAAKNQVAMNPINTVFDAKRLIGRRFSDASVQSDIKHWSFKVVPGPGDKPMITVTYKGEDKQFAAEEISSMVLIKMREIAEAYLGSTVKNAVVTVPAYFNDSQRQATKDAGVIAGLNVMRIINEPTAAAIAYGLDKKATSVGEKNVLIFDLGGGTFDVSLLTIEEGIFEVKATAGDTHLGGEDFDNRMVNHFVQEFKRKHKKDITGNARSLRRLRTSCERAKRTLSSTAQTTIEIDSLYEGIDFYSTITRARFEELNMDLFRKCMEPVEKCLRDAKMDKSTIHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIENMVQEAEKYKSEDEEHKKKVEAKNALENYAYNMRNTVKDEKISAKLPPADKKKIEDAVEQAIQWLDSNQLAEADEFEDKMKELESICNPIIAKMYQGAGGPDAGAGAMDDDGPSAGGSGAGPKIEEVD

SEQ ID NO: 2805 - protein, 358 aa, Vitis vinifera
MTCYKGKYHDELIANAAYIGTPGKGILAADESTGTIGKRLASINVENVEGNRRALRELLFCTPGALQYLSGVILFEETLYQKTASGKPFVDVMKEGGVLPGIKVDKGTVVLTGTDGETTTQGLDGLGERCAKYYAAGARFAKWRAVLKIGPTEPSELAIHENAYGLARYAMICQENGLVPIVEPEILVDGPHDIEKCAYVTERVLAACYKALNDHHVLLEGTLLKPNMVTPGSEAKKVSPEVVAEYTVRTLQRTVPAAVPAIVFLSGGQSEEEATLNLNAMNKLKGKKPWNLSFSFGRALQQSTLKAWSGKEENVVKARGAFLVRCKANSEATLGTYKGDAKLGEGAAESLHVKDYKY

SEQ ID NO: 2806 - protein, 401 aa, Vitis vinifera
MATKRSVGDLKEADLKGKRVFVRVDLNVPLDESLKITDDTRVRAAVPTIKYLMGHGAKVILASHLGRPKGVTPKYSLKPLVPRLSELLGVEVKMANDCIGEEVKILVAKIPEGGVLLLENVRFYKEEEKNDPEFAKKLASLADLYVNDAFGTAHRAHASTEGVAKYLKPSVAGFLMQKELDYLVGAVSNPKRPFAAIVGGSKVSSKIGVIESLLGKVDVLLLGGGMIFTFYKAQGYGVGSSLVEEDKLDLATSLLEKAKSKGVSLLLPADVVIADKFAADANSKVVPASCIPDGWMGLDIGPDSIKTFGESLDTTKTIIWNGPMGVFEFDKFALGTEAIAKKLADLSEKGVTTIIGGGDSVAAVEKVGLAEKMSHISTGGGASLELLEGKTLPGVLALDDA

SEQ ID NO: 2807 - protein, 447 aa, Vitis vinifera
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDMINEPKRPTDKPLRLPLQDVYKIGGIGTVPVGRVETGVLKPGMVVTFGPSGLTTEVKSVEMHHESLPEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPSGAKVTKSAAKKK

SEQ ID NO: 2808 - protein, 380 aa, Vitis vinifera
MSSTAGQVIRCKAAVAWEAGKPLVIEEVEVAPPQVMEVRLKILFTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPVYHFVGTSTFSEYTVVHVGCVAKINPAAPLDKVCVLSCGISTGLGATLNVAKPSKGSSIAIFGLGAVGLAAAEGARIAGAARIIGIDLNPKRFNDAKKFGVTEFLNPKDHDKPIQEVIAEMTGGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 2809 - protein, 649 aa, Vitis vinifera
MAGKGEGPAIGIDLGTTYSCVGVWQHDRVEIIANDQGNRTTPSYVAFTDTERLVGDAAKNQVAMNPINTVFDAKRLIGRRFSDATVQSDIKLWPFKVVAGPGDKPMIVVNYKGEEKQFAAEEISSMVLMKMREIAEAYLGSAVKNAVVTVPAYFNDSQRQATKDAGVIAGLNVMRIINEPTAAAIAYGLDKKATSVGEKNVLIFDLGGGTFDVSLLTIEEGIFEVKATAGDTHLGGEDFDNRMVNHFVQEFKRKHKKDISGNPRALRRLRTACERAKRTLSSTAQTTIEIDSLYEGVDFYTTITRARFEELNMDLFRKCMEPVEKCLRDAKMDKSSVHDVVLVGGSTRIPKVQQLLQDFFNGKELCKSINPDEAVAYGAAVQAAILSGEGNDKVQDLLLLDVTPLSLGLETAGGVMTVLIPRNTTIPTKKEQVFSTFSDNQPGVLIQVYEGERTRTRDNNLLGKFELSGIPPAPRGVPQITVCFDIDANGILNVSAEDKTTGQKNKITITNDKGRLSKEEIEKMVQEAEKYKSEDEEHKKKVDAKNALENYAYNMRNTVKDEKIGAKLPPADKKKIEDAIEQAIQWLDNNQLAEADEFEDKMKELESICNPIIAKMYQGAGGPDMGGGMDEDGPSAGGSGAGPKIEEVD

SEQ ID NO: 2810 - protein, 340 aa, Vitis vinifera
MESSDKKIKIGINGFGRIGRLVARVALQSNDVELVAVNDPFITTDYMTYMFKYDSVHGHWKHHDVKVKDSKTLLFGEKSVTVFGVRNPEEIPWAETGADYVVESTGVFTDKDKAAAHLKGGAKKVIISAPSKDAPMFVMGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMSFRVPTVDVSVVDLTVRLEKSATYDEVKAAIKEESEGKLKGILGYTEDDVVSTDFIGDSRSSIFDAKAGIALNANFLKLVSWYDNEWGYSSRVIDLIRHMASV

SEQ ID NO: 2811 - protein, 1052 aa, Vitis vinifera
MAGNDWINSYLEAILDVGPGLDDAKTSLLLRERGRFSPTRYFVEQVITGFDETDLHRSWVRAAATRSPQERNTRLENMCWRIWNLARQKKQLEGEEAQRIAKRRLERDRGRREAIADMSEDLSEGEKGDTVSDISAHGDSIRGRMPRISSVDAMETWVSYQKGKKLYIVLISLHGLIRGENMELGRDSDTGGQVKYVVELARALGSMPGVYRVDLLTRQVSSPEVDWSYGEPTEMLTPLNSESFMEDMGESSGSYIIRIPFGPKDKYVEKELLWPYIPEFVDGALNHIIQMSKVLGEQIGDGQPVWPVAIHGHYADAGDSAALLSGALNVPMLFTGHSLGRDKLEQLLKQGRISRDEINTTYKIMRRIEAEELALDASEIVITSTRQEIEQQWRLYDGFDPILERKLRARIRRNVSCYGRFMPRMVIIPPGMEFHHIVPHDGDMDGETEGNEDHPRTPDPVIWSEIMRFFTNPRKPMILALARPDPKKNITTLVKAFGECRPLRELANLTLIMGNRDGIDEMSSTSASVLLSILKLIDKYDLYGQVAYPKHHKQSDVPDIYRLAAKTKGVFINPAFIEPFGLTLIEAAAYGLPIVATRNGGPVDIHRVLDNGLLVDPHDQQSIADALLKLVADKQLWAKCRQNGLKNIHLFSWPEHCKTYLTKIASCKPRHPQWQRTDDGTENSDTDSPGDSLRDIQDISLNLKFSLDGHKNEASGNPENSDENAVDGKSKLENAVLTWSKGFVRDTRKAGFTEKSDQNTGTGKFPALRRRKHIFVIAVDCDTNTDTLETAGKILEAFGKEKTEGSVGFILSTSMSISEVHSFLVSGGLSPSDFDAFVCNSGSDLYYSSLTSEDSPFVLDLYYHSHIEYRWGGEGLRKSLVRWTASINDKMADNERIVVENEQVLTEYCYAFKVQKPGMVPPVKELRKLMRIHALRCHVIYCQNGTKLNVIPIMASRSQALRYLYVRWGVDLSNIVVFVGESGDTDYEGLLGGVHKTVILKGVCASNQLHANRTYPLTDVVPFDSPNIVQMTEDCSGSDIRSSLEKVGVLKG

SEQ ID NO: 2812 - protein, 811 aa, Vitis vinifera
MVTPKLGRSPSIRDRVEDTLSAHRNELVALLSRYVAQGNGILQPHHLIDELDNIVGDDVGRQKLSDGPFGQILKSTQEAIILPPFVAIAVRPRPGVWEYVRVNVHELSVDQLSVSEYLRFKEELVDGMFNDYYVLELDFEPFNASFPRPNRSSSIGNGVQFLNRHLSSIMFRNKESLEPLLDFLRVHKYKGQVIMLNDRIQSISRLQSALVKADDHLTKLPPETPFGEFEYEFQGMGFERGWGDTAQRVLEMIHLLLDILQAPDPSTLETFLGRIPMVFNVVILSPHGYFGQANVLGLPDTGGQVVYILDQVRALENEMLLRMQKQGLDVTPRILIVTRLIPDAKGTTCNQRLERVSGTEHSHILRVPFRTDKGILRKWISRFDVWPYLETFAEDAASEIAAELQGVPELIIGNYSDGNLVASLLASKLGVTQCTIAHALEKTKYPDSDIYWKNFDDKYHFSCQFTADLIAMNNADFIITSTYQEIAGSKNTVGQYESHTAFTLPGLYRVVHGIDVFDPKFNIVSPGADMCIYFPYSDVEKRLTALHGSIEKLLYDPEQNEEHIGMLNDRSKPIIFSMARLDQVKNITGLVECYAKNAKLREMANLVVVAGYNDVKKSNDREEIVEIEKMHDLMKEYNLHGQFRWMSSQTNRARNGELYRYIADTRGIFVQPAFYEAFGLTVVEAMTCGLPTFATCHGGPAEIIENGVSGFHIDPYHPDQVATTMVDFFEKCKEDSSHWNKISDAGLQRIYERYTWKIYSERLMTLAGVYGFWKYVSKLSRRETRRYLEMFYTLKFRDLAKSVPLAIDDQH

SEQ ID NO: 2813 - protein, 206 aa, Vitis vinifera
MEEEHHHSKTHECETTVVAEEAAVETKDRGIFDFLGKKEEEKPQEEVIVTDFEKVTISEPEPKVEEEEEKKHGLLEKLHRSDSSSSSSSEEEGEGGEKKKKKKKDKKKKEEDTCVPVEKCDEVVPPQPEEKKGFLDKIKEKLPGQHKKAEEVPPPPPPPAECSPSSETHEGEVKEKKGILEKIKEKLPGYHPKTEEEKKEKEKDCE

SEQ ID NO: 2814 - protein, 337 aa, Vitis vinifera
MGKIKIGINGFGRIGRLVARVALQRDDVELVAVNDPFITTDYMTYMFKYDSVHGQWKHHELKVKDSNTLLFGEKPVTVFGIRNPEEIPWGETGAEFVVESTGVFTDKDKAAAHLKGGAKKVVISAPSKDAPMFVVGVNEKEYKPELHIVSNASCTTNCLAPLAKVINDRFGIVEGLMTTVHSITATQKTVDGPSMKDWRGGRAASFNIIPSSTGAAKAVGKVLPSLNGKLTGMAFRVPTVDVSVVDLTVRLEKAATYEQVKAAIKEESEGKMKGILGYTEDDVVSTDFIGDNRSSIFDAKAGIALNEKFLKIVAWYDNEWGYSSRVIDLIVHMASCK

SEQ ID NO: 2815 - protein, 621 aa, Vitis vinifera
MEALSKGSLKMRELRRSSSLMCGPNGTQTPPYFSRWEAMVMFKVSRVTTSPFDGQKPGTSGLRKKVKVFKQQNYLHNFVQSTFNALSQDKIRGMTLVVSGDGRYFSKDAIQIIIKMAAANGVRSVWVGQNGLLSTPAVSAVIRERVGKDGTKASGAFILTASHNPGGPNEDFGIKYNMENGGPAQEAITDKIYENTKSIKEYIIAEDLPDVDISAIGITNFTGPEGQFDVEVFDSAFDYVKLMKSIFDFQSIQKLLSSPKFTFCYDALHGVGGAYAKRIFVEELGAQESSLLNCVPKEDFGGGHPDPNLTYAKELVACMGLGKSDAKNEPPEFGAASDGDADRNMILGKRFFVTPSDSVAIIAANAVDAIPYFSAGLKGVARSMPTSAALDVVAKHLNLKFFEVPTGWKFFGNLMDAGLCSICGEESFGTGSDHIREKDGIWAVLAWLSILAYENKENLGGAKLVTVEEIVRNHWATYGRHYYTRYDYENVDAGAAKELMAYLVKLQSSLPEVNKIIKGIHSDVSNVAKADEFEYKDPVDGSISKHQGIRYMFEDGSRLIFRLSGTGSEGATIRVYIEQYEKDSSKTGRDSQEALGPLVEVALKLSKMQEFTGRSAPTVIT

SEQ ID NO: 2816 - protein, 812 aa, Vitis vinifera
MSEFNEIPLHGTLHATIFEIDRLHSGGAPKFFRKLVENIEETVGFGKGTSKLYATIDIGRARVGRTRMIENEPSNPRWYESFHIYCAHMAGHIIFTVKDDNPIGATLIGRASVPIQEILGGEEVDKWVEIVNEELKPIHGGSKIHVKLQYFEVTADRSWGRGIRSLKFPGVPFTFFSQRKGCHVSLYQDAHVPDNFVPKIPLADGKYYEPRRCWEDVFDAINNAKHLIYITGWSVYTEITLVRDSRRPKPGGDLTIGELLKKKASEGVRVLMLVWDDRTSVPLLKKDGLMGTHDEETEHYFHDTDVHCVLCPRNPDDGGSIVQDLQISTMFTHHQKIVVVDSEMPSGGSEKRRIVSFVGGIDLCDGRYDTQFHSLFRTLDTAHHDDFHQPNFEGASIQKGGPREPWHDIHSRLEGPIAWDVLFNFEQRWRKQGGKDILLQLRDLDDVIIPPSPVMFPDDQEVWNVQLFRSIDGGAAFGFPETPEEAARAGLVSGKDNIIDRSIQDAYINAIRRAKDFIYIENQYFLGSSFGWAPDEGIKIEDVGALHLIPKELSLKIASKIEAGEKFTVYIVVPMWPEGMPESGSVQAILDWQRRTMEMMYKDIIKALADKGIEDDPRNYLTFFCLGNREVKKSGEYEPSEHPEPDTDYSRAQEARRFMIYVHAKMMIVDDEYIIIGSANINQRSMDGARDSEIAMGGYQPYHLASRQPARGQIHGFRMSLWYEHLGMLDESFLQPESKECIQKVNQIAEKYWDLYASETLEHDLPGHLLRYPIAVSCGGDITELPGAEFFPDTKARVLGTKSEYLPPILTT

SEQ ID NO: 2817 - protein, 413 aa, Vitis vinifera
MAGVAPEGSQFDTRNYDAKMTELLSTDGQDFFTSYDEVYDSFDSMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQRFYNVVIEELPSNVADLL

SEQ ID NO: 2818 - protein, 591 aa, Vitis vinifera
MESTLKDIRDGASVLDLDPKATVGGGVEDLYGEDFATEDQLVTPWTVSVASGYSLLRDPRHNKGLAFNDKERDAHYLCGLLPPVVSTQELQERKLMNSIRQYQVPLQKYMAMMDLQERNERLFYKLLIDNVEELLPVVYTPTVGEACQKYGSIFRRPQGLYISLKEKGKILEVLKNWPERRIQVIVVTDGERILGLGDLGCQGMGIPVGKLSLYTALGGVRPSACLPITIDVGTNNEKLLANEFYIGLKQRRATGKEYSEFLQEFMSAVKQNYGEKVLIQFEDFANHNAFDLLAKYGTTHLVFNDDIQGTASVVLAGIVSALRLLGGTLADHKFLFLGAGEAGTGIAELIALEMSKQTKCPIEETRKKIWLVDSKGLIVSSRKDSLQQFKKPWAHEHEPVKDLLHAVKVIKPTVLIGSSGVGKAFTKEVIEAMASCNEKPLILALSNPTSQSECTAEEAYTWTQGRAIFASGSPFDPVEYNGKTFVPGQANNAYIFPGLGMGLVISGAIRVHDEMLLAASEALARQVTQENFDKGLIYPPFSNIRKISAHIAANVAAKAYELGLATRLPQPENLVKYAESCMYSPVYRSYR

SEQ ID NO: 2819 - protein, 606 aa, Vitis vinifera
MAEDGKKPVSEEAQKPVAEASVVEEVVAVAEVTAPPPAVPEAEEAAEKLKEEEEVVEKLEEEVAAAEEEKPKVVEEGEKMTESVSFKEESNVVGDLPESQRKALEELKVLVREALEKHEFTAPPPPPPPPAKEEEKAPATEEEPKTEAPAEPAPEVVCPPPVEESEKKEEKEEEKKEEEKKEEEKKEEEKVAPPEPAEPVVVAAVVETVTAVVVDEDGTKTVEAIEETIVVAPPAPPAEEAAAVVEEVTPPPPAEEVPPPPPPPPEEVEIWGIKLFDDDRTDVVLLKFLRARDFKPKEALTMLKNTVLWRKSFGIETLLGDDLGTHLESVVFMEGSGKEGHPVCYNAYGKFLNKELYQNTFSDEEKRQNFLRWRIQFLEKSIRKLDFSPNGINTIIQVNDLKNSPGPFKRELRQSTNQALHLLQDNYPEFVAKQIFINVPWWYLAFNRMISPFLTQRTKSKFVFAGPSKSAETLFKYIAPEQVPVQYGGLKRDGDTEFSICDPVTLVTIKPGCKHVIEFPYSEPCQLIWELRVIGWDVTYGAEFVPTVEGGYTVIVQKARKIAPTDEPVISNSFKIGEPGKVILTIDNQTSKKKKLLYRSKTQPCD

SEQ ID NO: 2820 - protein, 806 aa, Vitis vinifera
MSNQAESSDSKGTKRDFSTAILERKKAANRLVVDEAVNDDNSVVALHPDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPAEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSEDVDLERIAKDTHGYVGADLAALCTEAALQCIREKMDVIDLEDESIDAEILNSMAVTDEHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRENPEAMEEDVDEEVAEIKAAHFEESMKYARRSVSDADIRKYQAFAQTLQQSRGFGTEFRFSETSTGAAGSDPFAASAGGAADEDDLYS

SEQ ID NO: 2821 - protein, 309 aa, Vitis vinifera
MATLSVTEDCEQLRKAFAGWGTNEGLIISILAHRNAAQIKSIRQTYAQTYGEDLLKDLNKELSNDFERVVLLWTLDPAERDAFLANEATKRWTSSNQVLVEIACTRTSQQLLLAKQAYHARFKRSLEEDVAYHTSGDFRKLLVPLVGTYRYEGEEVNMTLAKSEAKILHEKISEKAYNHEDVIRILATRSKAQINATLNHYKNEFGNDINKDLKTDPKDEFLAILRATVKCLTRPEKYFEKVLRLAINKRGTDEGALTRVVTTRAEIDMKIIKEEYHKRNSVTLDHAIGKDTTGDYEKMLLALIGHGDA

SEQ ID NO: 2822 - protein, 451 aa, Vitis vinifera
MEFSPRAAELTTLLESRITNFYTNLKVDEIGRVVSVGDGIARVYGLNEIQAGEMVEFASSVKGIALNLDNENVGIVVFGSDTAIKEGDLVKRTGSIVDVPAGKAMLGRVVDALGVPIDGRGALSDHERRRVEVKAPGIIERKSMHEPMQTGLKAVDSLVPIGRGQRELIIGDRQTGKTAIAIDTILNQKLLNSKATSDSDTLYCVYVAIGQKRSTVAQLVQILSEANALEYSILVAATASDPAPLQFLAPYSGCAMGEYFRHNGMHALIIYDDLSKQAVAYRQMSLLLRRPPGREAFPGDLFYRGIRPAINVGLSVSRVGSAAQLKAMKQVCGSSKLELAQYREVAALAQFGSDLDAANQALLNRGARLTEVSKQPQYAPLPIEKQILVIYAAVNGFCDRMPLDRISQYERAIPSSIKPEFLQSLLEKGGLTNERKMEPDAFLKESALPYL

SEQ ID NO: 2823 - protein, 572 aa, Vitis vinifera
MDSENVDGVAHDLVSLLTREDRDFLVRNNGHQVKVESLKGKKIWLYFSASWCGPCRRFTPKLVEAYNELSSNDDFEIIFVSGDNDDESFNGYFSKMPWLAIPFSDSDARDQLNELFKVMGIPNLVMLDESGKVLSEDGVDIIQEYGVEAYPFTPEKIKEMKEKEETARKEQSLRSILVSQSRDYVISTDGKKVPVSELEGKFVGLFFSLSSYKACLEFTPTLVDVYEKLRAKGESFEIVMISLDDEEESFKKYFGSMPWLALPFRDKSCEKLARYFELSALPTLVVIGPDGKTLHSNVAEAIQEHGIQAYPFTPEKFAELEEIEKAKREAQTLESILVSGDRDFVIGKDGVKIPVSDLVGKNILLYFSAHWCPPCRAFLPKLIEAYQKIKTKDEAFEVIFISSDKDQTSFDEFFSGMPWLALPFGDKRKASLSRTFKVHGIPSLIAIGPTGRTVTTEARNLVMIHGADAYPFTEEHIREIEAQYEEMAKGWPEKVKHALHEEHELVLTKRRVYVCNGCEKQGHLWSFYCEECDFDLHPKCALEEDKGSKDDEMEKASPGEGWKCDGEVCYKA

SEQ ID NO: 2824 - protein, 1009 aa, Vitis vinifera
MYMATSPYSSLALLRASRVRFAPSISRVSLSSSSSSSSPHPPCPSRIPASASSSSLPFSTISGGYRSLGFLSAFRSRRWSHGVDWRSPVSLRAQIRAAAPVIERFERKMATIASEHPFKGILTSVPKPGGGEFGKFYSLPALNDPRIDKLPYSIRILLESAIRNCDNFQVTKDDVEKIIDWENTSPKQVEIPFKPARVLLQDFTGVPAVVDLACMRDAMNNLGSDSNKINPLVPVDLVIDHSVQVDVTRSENAVQANMDLEFQRNKERFSFLKWGSTAFRNMLVVPPGSGIVHQVNLEYLGRVVFNNDGILYPDSVVGTDSHTTMIDGLGVAGWGVGGIEAEAAMLGQPMSMVLPGVVGFKLSGKLCSGVTATDLVLTVTQMLRKHGVVGKFVEFYGEGMGELSLADRATIANMSPEYGATMGFFPVDHVTLQYLKLTGRSDETVAMIEAYLRANRMFVDYNEPQVERFYSSYLQLNLEDVEPCMSGPKRPHDRVPLKEMKTDWKACLDNKVGFKGFAVPKEAQDKVAKFSFHGQPAELKHGSVVIAAITSCTNTSNPSVMLGAGLVAKKASELGLEVKPWIKTSLAPGSGVVTKYLLQSGLQKYLNQQGFHIVGYGCTTCIGNSGDLDESVASAISENDIIAAAVLSGNRNFEGRVHALTRANYLASPPLVVAYALAGTVDIDFEKEPIGTGKDGKDVYFKDIWPTSEEIAEVVQSSVLPEMFKSTYEAITKGNPIWNQLSVHSSSLYSWDPNSTYIHEPPYFKNMTMNPPGPHGVKDAYCLLNFGDSITTDHISPAGSIHKDSPAAKYLIERGVAPKDFNSYGSRRGNDEVMARGTFANIRIVNKLLNGEVGPKTIHIPTGEKLYVFDAAMRYKADGHDTIVLAGAEYGSGSSRDWAAKGPMLQGVKAVIAKSFERIHRSNLVGMGIIPLCFKAGEDADTLGLTGHERYNIDLPSKISEIRPGQDVTVTTDNGKSFTCTVRFDTEVELEYFNHGGILPYAIRNLINQ

SEQ ID NO: 2825 - protein, 1705 aa, Vitis vinifera
MAAANAPISMKEALTLSSIGISPQFMTFTHVTMESDKYICVRETAPQNSVVIIDMSMPMQPLRRPITADSALMNPNSRILALKAQLPGTTQDHLQIFNIEMKAKMKSHQMPEQVVFWKWITPKMLGLVTQTSVFHWSIEGDSEPVKMFERTANLVNNQIINYRCDPSEKWLVLIGIAPGSPERPQLVKGNMQLFSVDQQRSQALEAHAASFASFKVLGNENPSTLICFASKTTNAGQITSKLHVIELGAQPGKPGFTKKQADLFFPPDFADDFPVSMQVSQKYGLIYVITKLGLLFVYDLETASAVYRNRISPDPIFLTAEASSIGGFYAINRRGQVLLATVNEATIVPFVSGQLNNLELAVNLAKRGNLPGAENLVVQRFQELFAQTKYKEAAELAAESPQGLLRTPDTVAKFQSVPVQSGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNLIREATAFLLDVLKPNLPEHGFLQSKVLEINLVTFPNVADAILANGMFSHYDRPRIAQLCEKAGLYVRALQHYTELPDIKRVIVNTHAIEPQALVEFFGTLSREWALECMKDLLLVNLRANLQIIVQTAKEYSEQLGVEACIKLFEQFKSYEGLYFFLGSYLSSSEDPDIHFKYIEAAAKTGQIKEVERVTRESNFYDAEKTKNFLMETKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWEKVLSPDNEYRRQLIDQVVSTALPESKSPEQVSAAVKAFMTADLPHELIELLEKIVLQNSAFSGNFNLQNLLILTAIKADPSRVMDYINRLDNFDGPAVGDVAVEAQLYEEAFAIFKKFNLNVQAVNVLLDNIQSIERAVEFAFRVEEDAVWSQVAKAQLKEGLVSDAIESFIRADDATQFLDVIRAAENANVYHDLVRYLLMVRQKTKEPKVDSELIYAYAKIDRLGDIEEFILMPNVANLQNVGDRLYDEALYEAAKIIFAFISNWAKLACTLVKLRQFQGAVDAARKANSSKTWKEVCFACVDAEEFRLAQICGLNIIIQVDDLEEVSDYYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVAVKVANVELYYKAVHFYLQEHPDLINDLLNVLALRVDHTRVVDIMRKAGHLHLVKPYMVAVQSTNVAAVNEALNGIHVEEEDYDRLRESIDMHDNFDQIGLAQKVEKHELLEMRRIAAYIYKKAGRWKQSIALSKKDNLYKDAMETCSQSGDRELAEELLVYFIEQKKKECFASCLFVCYDLIRPDVVLELAWMNNMIDFAFPYLLQFIREYTGKVDDLVKDRIEALKETKAKEEEEKDVVKQQNMYAQLLPLALPAPPMPGMGGAGMGGGFAAPPPMGGMGMPPMPPFGMPPMGSY

SEQ ID NO: 2826 - protein, 51 aa, Vitis vinifera; identical to SEQ ID NO: 615

SEQ ID NO: 2827 - protein, 114 aa, Vitis vinifera
MAEEGQVVGCHSVESWKEQFQHGIESKKLVVVDFTASWCGPCRVISPFLAELAKKMPNVIFLKVDVDELETVAKEWEVEAMPTFLFLKEGNVVDKVVGAKREELVQKTEKHATA

SEQ ID NO: 2828 - protein, 250 aa, Vitis vinifera
MGKSYPTVSEEYKKAVEKAKKKLRGLIAEKNCAPIMLRIAWHSAGTFDVKTRTGGPFGTMKKPEELAHGANNGLDIAVRLLEPIKEQFPIISYADFYQLAGVVAVEVTGGPEIPFHPGREDKPEPPPEGRLPDATKGCDHLRQVFVTQMGLSDKDIVALSGAHTLGRCHKERSGFEGPWTSNPLIFDNSYFKELLSGEKEGLLQLPSDKALLSDPAFRPLVEKYAADEDAFFEDYKEAHLKLSELGFADA

SEQ ID NO: 2829 - protein, 368 aa, Vitis vinifera
MRAVAFLLLLLCATCHIALSFTDGLLPNGNFELGPKPSDMKGTEVIGPHAIPEWETSGFIEYIKAGQKQGDMLLVVPEGAFAVRLGNEASIKQRVKVIKGMYYSITFSAARTCAQEERLNISVAPDWGVLPMQTLYSSNGWDSYAWAFQADYDVIEIVIHNPGVEEDPACGPLIDSVAFRALYPPRPSSKNLLKNGGFEEGPYVFPNTSWGVLIPPNIEDDHSPLPGWMVESLKAVKYIDSDHFSVPQEKRAVELVAGKESAIAQVARTIPGKTYALSFSVGDASNSCEGSMVVEAFAGRDTIKVPYESKGKGGFKRAVLRFVAVSNRTRIMFLSTFYTMRSDDYASLCGPVLDDVKLLSLRTPPRHI

SEQ ID NO: 2830 - protein, 434 aa, Vitis vinifera
MAEKHFKYVILGGGVSAGYAAREFAKQGVKPGELAIISKEAVAPYERPALSKAYLFPEGAARLPGFHVCVGSGGERLLPEWYKEKGIELILSTEIVKADLASKTLISAAGETFKYHILIIATGSTVIRLTDFRVEGADAKNILYLREINDADKLIDVIKAKKNGKAVIVGGGYIGLELSAVMKINNLDVCMVYPEPWCMPRLFTAGIAAFYEGYYANKGIKIIKGTVAVGFTSDANGEVKEVKLKDGRVLEADIVVVGVGGRPLTTLFKGQVEEEKGGIKTDEFFKTSVPDVYAVGDVATFPLKLYNEIRRVEHVDHARKSAEQAVKAIKASEEGKSVEEYDYLPYFYSRAFDLSWQFYGDNVGETVLFGDNNPASPKAKFGTYWIKDGKVVGAFLEGGTPEENTAIAKVARLQPAVENLDQLTKEGLTFACKI

SEQ ID NO: 2831 - protein, 489 aa, Vitis vinifera
MEKLSQLRSAVAGLDQISENEKSGFINLVSRYLSGEAQHIEWSKIKTPTDEVVVPYDTLAPTPEDSVETKKLLDKLVVLKLNGGLGTTMGCTGPKSVIEVRNGLTFLDLIVIQIENLNNKYGCKVPLLLMNSFNTHDDTLKIVQKYEKSNIEIHTFNQSQYPRVVVDDFSPLPSKGNTGKDGWYPPGHGDVFPALMNSGKLEKLLSQGKEYVFVANSDNLGAVVDLKILNHLIKNKNEYCMEVTPKTLADVKGGTLISYEGKVQLLEIAQVPDEHVNEFKSIEKFKIFNTNNLWVNLNAIKRLVEADALKMEIIPNPKEVDGIKVLQLETAAGAAIRFFDNAIGINVPRSRFLPVKATSDLLLVQSDLYTLSDGFVVRNKARKNPENPVIELGPEFKKVGNFLSRFKSIPSIIELDSLKVAGDVWFGSGVILKGKVTIEAKAGVKLEIPNGAVVANKGKVNIEAKAGVKLEIPNGAVVANKVINGPQDI

SEQ ID NO: 2832 - protein, 729 aa, Vitis vinifera
MAAASASSSLYLLPRTLNHHSSTPHPNRLSLSGLTPKTQALRTRHGRRARATVRAAAVETLQKADTSLVEKSINTIRFLSIDAVEKANSGHPGLPMGCAPMGHILYDEVMRYNPSNPYWFNRDRFVLSAGHGCMLQYALLHLAGYDSVKEEDLKSFRQWGSRTPGHPENFETPGVEVTTGPLGQGIANAVGLAAVEKHLAARFNKPDNEIVDHYTYVILGDGCQMEGISNEVCSLAGHWGLGKLIAFYDDNHISIDGDTEIAFTESVDTRFEGLGWHVIWVKNGNTGYDEIRAAIKEAKAVKDKPTLIKVTTTIGYGSPNKANSYSVHGSALGAKEVDATRKNLGWPHEPFHVPEDVKKHWSRHIPDGAALEAEWNAKFAEYEKKYKEEAAELKSIITGELPAGWDKALPTYTPESAADATRNLSQQCLNALAKVLPGLLGGSADLASSNMTLLKMFGDFQKGTPEERNVRFGVREHGMGAICNGIALHSLGLIPYCATFFVFTDYMRAAIRISALSEAGVIYVMTHDSIGLGEDGPTHQPIEHLASFRAMPNILMLRPADGNETAGAYKVAVVNRKRPSILALSRQKLPQLPGTSIAGVEKGGYAISDNSSGNKPDVILIGTGSELEIAAKAGDELRKEGKTVRVVSLVSWELFDDQSDAYKESVLPAAVTARVSIEAGSTFGWEKIVGSKGKAIGIDRFGASAPAGKIYKEFGITVEAVIEAAKAVW

SEQ ID NO: 2833 - protein, 765 aa, Vitis vinifera
MASHIVGYPRMGPKRELKFALESFWDKKSSAEDLQKVAADLRASIWKQMADAGTKYIPSNTFSYYDQVLDTTAMLGAVPPRYGWNGGEIEFDVYFSMARGNASVPAMEMTKWFDTNYHYIVPELGPEVKFSYASHKAVKEYQEAKALGVDTVPVFVGPVSYLLLSKPAKGVEKSFSLLSLLDKILPIYKEVVAELKAAGASSIQFDEPTLVMDLDSHKLQAFTHAYSELEASCSGLNVIVETYFADVPSEAFKTLTSLKGVTGFGFDLVRGTKTLDLIKVGFPTGKYLFAGVVDGRNIWANDLAASLSVLQELESIVGKDKLVVSTSCSLLHTAVDLINEPKLDQEIKSWLAFAAQKIVEVNALAKALAGHKEEAFFSDNASAQASRKSSPRVTNEAVQKAASALKGSDHRRATDVSARLDAQQRKLKLPVLPTTTIGSFPQTMDLRRVRREYKAKKISEEDYVKAIKEEINKVVKLQEELDIDVLVHGEPERNDMVEYFGEQLSGFAFTANGWVQSYGSRCVKPPIIYGDVSRPKPMTVFWSTMAQSMTARPMKGMLTGPVTILNWSFVRNDQPRFETCYQIALAIKDEVEDLEKAGITVIQIDEAALREGLPLRKSEHAFYLDWAVHSFRITNCGVQDTTQIHTHMCYSNFNDIIHSIIDMDADVITIENSRSDEKLLSVFREGVKYGAGIGPGVYDIHSPRIPSTEEIADRINKMLAVLETNILWVNPDCGLKTRKYTEVMPALKNMVAAAKLLRTELASAK

SEQ ID NO: 2834 - protein, 918 aa, Vitis vinifera
MFLCRKYSQSNFSKRKNNYASSNPFASILKTLEKPAGGEFGKYYSLPALGDPRIDRLPYSIRILLESAIRNCDEFQVKAKDVEKIIDWENSSPKQVEIPFKPARVLLQDFTGVPAVVDLACMRDAMNKLGGDSNKINPLVPVDLVIDHSVQVDVAGSENAVQANMELEFQRNKERFGFLKWGSNAFHNMLVVPPGSGIVHQVNLEYLGRVVFNTEGILYPDSVVGTDSHTTMIDGLGVAGWGVGGIEAEAAMLGQPMSMVLPGVVGFKLSGKLRDGVTATDLVLTVTQMLRKHGVVGKFVEFYGEGMRELSLADRATIANMSPEYGATMGFFPVDHVTLQYLKLTGRRDETVSMIESYLRANNMFVDYSQPQVEKVYSSYLELNLEDVEPCVSGPKRPHDRVPLKEMKADWHSCLDNKVGFKGFAIPKESQSKVVEFSYHGTPAQLRHGDVVIAAITSCTNTSNPSVMLGAALVAKKACELGLEVKPWIKTSLAPGSGVVTKYLEKSGLQKYLNQLGFHIVGYGCTTCIGNSGDINESVASAISENDMVAAAVLSGNRNFEGRVHPLTRANYLASPPLVVAYALAGTVDIDFEKEPIGVGKDGKQIFFRDIWPSTEEVANVVQSSVLPAMFKATYEAITQGNPMWNQLSVPSSTLYTWDPKSTYIHDPPYFKSMTMSPPGPHGVKDAYCLLNFGDSITTDHISPAGSIHKDSPAARYLMERGVDRRDFNSYGSRRGNDEIMARGTFANIRIVNKLLKGEVGPKTLHIPSGEKLSVFDAAMRYKSEGQDTIILAGAEYGSGSSRDWAAKGPMLLGVKAVIAKSFERIHRSNLVGMGIIPLCFKPGQDAETLGLTGHERYTIDLPSSVSEIKPGQDITVVTDNGKSFTCTMRFDTEVELAYFDHGGILQYAIRNLIGGRS

SEQ ID NO: 2835 - protein, 254 aa, Vitis vinifera
MGRKFFVGGNWKCNGTGEEVKKIVSTLNAGEVPSGDVVEVVVSPPFVFLPLVKSTLRPDFHVAAQNCWVKKGGAFTGEISAEMLVNLGIPWVIIGHSERRLLLNESNEFVGEKVAYALSKGLKVIACVGETLEQRESGSTMEVVAAQTKAIADKVSNWANVVLAYEPVWAIGTGKVATPAQAQEVHSELRNWFQANASPEVAATIRIIYGGSVSGANCKELAAKPDVDGFLVGGASLKPEFIDIIKSAEVKKNC

SEQ ID NO: 2836 - protein, 383 aa, Vitis vinifera
MTYNRNEDVSDEFDEYDPTPYGGGYDITVIYGRPLEPSEETCYPISSKSGDIDYDRPSYTSCSEPSAYGDEALENEYKSYARPKPRPVLGYAGPPPGQGGFGGSGDGGEYGYQPKPPSSFGGEGEYGSGHGRKPDYEEPSSEYGSGYGRKPECEQPSSEYGSGYGRKPEYEQPSSEYGSGYGRKPEYEQPSSEYGSGYGRKPEYEQPSTEYGSGYGRKPEYEQPSSEYGSGYGRRPEFEQPSSEYGSGYGRRPEYEAPSSEYGSGYGRKPSFGEEQGGGYGYGGEGSPRKPQYGRPSYESPEVEEPPRRPSYGRPSNEGQEEEGYEKPAYERRDDDDEPRKYGYGEEGYGRKKYGDDNSDDDEEKKSRKHHHHHHHRQSYDDE

SEQ ID NO: 2837 - protein, 429 aa, Vitis vinifera
MALYSLFRSAPSAAAAAAATVVDSSRPSDRCKVSCIGFNSNADSLKVQTTIFGTPCIGNSSSLQKCSARSLQPIKATATELPPTVQKSWSSGQTKIGINGFGRIGRLVLRVATSRDDIDVVAVNDPFVDAKYMAYMFKYDSTHGVFKGTIKVLDESTLEINGKQIKVTSKRDPSEIPWGDYGIDYVVESSGVFTTTEKASAHIKGGAKKVVISAPSADAPMFVVGVNETSYKPSMNIVSNASCTTNCLAPLAKVVHEEFGIVEGLMTTVHATTATQKTVDGPSMKDWRGGRGASQNIIPSSTGAAKAVGKVLPELNGKLTGMAFRVPTPNVSVVDLTCRLKKSATYEDVKAAVKYASEGPLKGILGYTDEDVVSNDFVGDSRSSIFDAKAGIGLSASFMKLVAWYDNEWGYSNRVLDLIEHMALVAASK

SEQ ID NO: 2838 - protein, 457 aa, Vitis vinifera
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 2839 - protein, 500 aa, Vitis vinifera
MRAVSSSWVWFVEKVMAPVSRIGLSGLAVMGQNLALNIAEKGFPISVYNRTTSKVDETVERAKQEGNLPLYGFHDPESFVNSIQKPRVIIMLVKAGAPVDQTIKTLSGYLEKGDCIIDGGNEWYENTERREKAMAELGLLYLGMGVSGGEEGARHGPSLMPGGSFEAYKYIEDILLKVAAQVPDSGPCVTYIGKGGSGNFVKMVHNGIEYGDMQLIAEAYDVLKSVGKLSNEELRNVFSEWNKGELLSFLIEITADIFSIKDDKGDGFLVDKVLDKTGMKGTGKWTVQQAADLSVAAPTIASSLDARFLSGLKEERVEAAKVFKSSGFENVLSDQTVDKKKLIDDVRQALYASKICSYAQGMNLIRAKSIEKGWDLKLGELARIWKGGCIIRAIFLDRIKKAYDRNADLANLLVDPEFAKEIVERQSAWRRVVCLAINSGISTPGMSSSLAYFDSYRRDRLPANLVQAQRDYFGAHTYERIDTTGSFHTEWFKIAQQSKI

SEQ ID NO: 2840 - protein, 606 aa, Vitis vinifera
MDTKISVTDASVPTNSNVGCPSNGIVSSILSSVPPSVISSSEATLGRHLARRLVQIGVSDVFSVPGDFNLTLLDHLIAEPGLKNIGCCNELNAGYAADGYARSRGVGACVVTFTVGGLSVLNAIAGAYSENLPVICIVGGPNSNDYGTNRILHHTIGLPDFSQEFRCFQTVTCYQAVVNNLEDAHEQIDTAISTALKESKPVYISISCNLPGIPHPTFSREPVPFCLAPKVTNQMGLEAAVEAAAAFLNKAVKPVMVGGPKLRVAKACEAFVELADACGYPVAVMPSAKGLVPECHPRFIGTYWGAVSTAFCAEIVESADSYIFAGPIFNDYSSVGYSLLLKKDKAILVQPERVVIGNGPAFGCILMKDFLKALSKRLKCNTTAYENYHRIYVPEGQPLRSDPKEPLRVNVLFQHIQKMLSSETAVIAETGDSWFNCQKLKLPKGCGYEFQMQYGSIGWSVGATLGYAQAVPNKRVISCIGDGSFQQVTAQDVSTMIRCEQRTIIFLINNGGYTIEVEIHDGPYNVIKNWNYTGLVDAIHNGEGKCWTTKVVCEEDLINAIETATGSKKDCFCFIEVIAHKDDTSKELLEWGSRVSAANSRPPNPQ

SEQ ID NO: 2841 - protein, 793 aa, Vitis vinifera
MRRWRDDGLKIEDSLRCSKMTVTPKISINEGNLVVQGKTILTGVPDNIVLTPGSGGGLVAGTFIGATASHSKSLHVFPMGTLDGLRFMCCFRFKLWWMTQRMGTCGKDVPFETQFMLIESKETTEGGEHDDAPTIYTVFLPLLEGQFRAVLQGNDKNEIEICLESGDTAVETNQGLHLVYMHSGTNPFEVIDQAVKAVEKHMQTFLHREKKKLPSFLDWFGWCTWDAFYTDVTAEGIEEGLQSLSKGGAPPKFLIIDDGWQQIGNENKDNNCVVQEGAQFANRLTGIKENEKFQKNGRNNEQVPGLKHVVEDAKQRHNVKFVYVWHALAGYWGGVKPAAAGMEHYECALAYPVQSPGVMGNQPDIVMDSLSVHGLGLVPPRTVFNFYNELHAYLASCGVDGVKVDVQNIIETLGAGHGGRVALTRSYQQALEASIARNFTDNGCISCMCHNTDGLYSTKQTAVVRASDDFYPRDPASHTIHISSVAYNTLFLGEFMQPDWDMFHSLHPAAEYHGAARAVGGCAIYVSDKPGHHNFELLRKLVLPDGSVLRAQLPGRPTRDCLFADPARDGTSLLKIWNVNKCSGVVGVFNCQGAGWCKIEKKTRVHDTSPDTLTGSVCAADVDQIAHVAGTNWKGDVVVYAYKSGEVVRLPEGASLPVTLKVLEFEVFHFCPLKEIATNISFAPIGLLDMLNSGGAVEQFEVHMASEKPELFDGEIPFELSTSLSENRSPTATIALTARGCGRFGAYSSQRPLKCQVGDAEVEFSYDPNNGLLTFTIPIPEEEMYRWSIAIQV

SEQ ID NO: 2842 - protein, 961 aa, Vitis vinifera
MAVSMRDLDPAFQGAGQKAGIEIWRIENFRPMPVPKSSYGKFFTGDSYVILKTTALKNGALRHDIHYWLGKDTTQDEAGTAAVKTVELDAALGGRAVQYREVQGHETEKFLSYFKPCIIPQPGGVASGFKHAEAEEHKTRLYVCKGKHVVHVKEVSFARSSLNHDDIFILDTKSKIFQFNGSNSSIQERAKALEVVQYIKDTYHDGKCEVASIEDGKLMADAETGEFWGFFGGFAPLPRKTANEDDKAVDSLPAKLFCILKGQAEPVQADSLTRELLDTNKCYILDCGVEVFVWMGRNTSLDERKSASSAAEELLRSLDRPKSHIIRVIEGFETVMFRSKFDMWPETTAVTVSEDGRGKVAALLKRQGVNVKGLLKAAPVKEEPQPYIDCTGNLQVWRVNGQEKTLLSASDQSKFYSGDCYIFQYSYPGEDKEEHLIGTWFGKQSVEEERTSAISLATKMVESLKFLPAQARIYEGNEPIQFFSIFQSFIVFKGGVSDGYKKYIAEKEVPDDTYTEDRVALFRVQGSGPDNMQAIQVEPVASSLNSSYCYILNSGSSVFNWSGNLTTPEDQELVERQLDVIKPNVQSKPQKEGSESEQFWEFLGGKSEYPSQKIARDAENDPHLFSCTFSKGNLKVTEIFNFTQDDLMTEDIFILDCHSEIFVWVGQQVDSKNRMHALTIGEKFLERDFLLEKLSHTAPIYIIMEGSEPPFFTRFFTWDSGKSAMQGNSFQRKLAIVKNGISPTPEKPKRRTPVSYGGRSSSLPEKSQRSRSMSFSPDRVRVRGRSPAFNALAANFENPNSRNLSTPPPMVRKLYPKSVTPDSSKLDSRSAAIAALSASFEQPAREPVVPKTPKVTEEAPKPKPKPETNSKEKAMSSRIEALTIEEDVKEGEAEDEEGLPIYPYERLKTTSIEPVAEIDVTKRETYLSSEEFRQKFGMTKDAFYKLPKWKQNKLKMALQLF

SEQ ID NO: 2843 - protein, 148 aa, Vitis vinifera
MEQTFIMIKPDGVQRNLVGEIIGRFEKKGFSLKGLKLLSVERGFAEKHYEDLSSKPFFNGLVEYIISGPVVAMIWEGKNVVTTGRKIIGATNPSDSAPGTIRGDFAVDIGRNVIHGSDSVGSARKEIALWFPEGPVAWSSSLNHWIYE

SEQ ID NO: 2844 - protein, 172 aa, Vitis vinifera
MANPKVFFDMSVGGVPAGRIVMELFADTTPRTAENFRALCTGEKGTGRSGKPLHYKGSKFHRVIPGFMCQGGDFTAGNGTGGESIYGSKFADENFIHKHTGPGILSMANAGPGTNGSQFFICTAKTSWLDGKHVVFGKVIEGLDVVKAIEKVGSSSGSTAKAVVVSDCGQLS

SEQ ID NO: 2845 - protein, 172 aa, Vitis vinifera
MTNPRVFFDVSIGGAPAGRIVMELYADTTPRTAENFRALCTGEKGVGRSGKPLHFKGSIFHRVIPSFMCQGGDFTRGDGTGGESIYGAKFEDENFIKKHTGPGILSMANAGPGTNGSQFFICTDKTEWLDGKHVVFGQVVEGMDVVKAVEKVGSGSGRTAKTVKIEDCGQLS

SEQ ID NO: 2846 - protein, 173 aa, Vitis vinifera
MATAEVVSATPALSEEKTEESVKAEETPVEEVAAAPPTPEPVAEEPKEAETAAVPEESAAPEAEAPADQDETKEVVEQVEVETKEVVEKTDQAVVEEPAVEKTEEVPEETPDQETNSPVVEETKEATEPAEEPAPKPEPAPADEAPKEEGPAAEEEEKPAEAKVKVETDEKAE

SEQ ID NO: 2847 - protein, 169 aa, Vitis vinifera
MASQSSPQSVHSFTVKDARGNDVDLSIYKGKALLIVNVASQCGLTNSNYTELHQLYEKYKDQGCLEILAFPCNQFGAQEPGSNEEIEKFVCTRFKAEYPIFDKIDVNGDSAAPLYKFLKSSKGGLFGDNIKWNFSKFLVDKDGKVVDRYAPTTSPLSIEKDIKKLLGIS

SEQ ID NO: 2848 - protein, 510 aa, Vitis vinifera
MANIDIEGILKELPNDGRIPKTKIVCTLGPASRSVPMLEKLLRAGMNVARFNFSHGTHDYHQETLDNLRIAMQNTQILCAVMLDTKGPEIRTGFLKDAKPIQLKEGEEITISTDYSIKGDEKMISMSYKKLPVDLKPGNTILCADGTITLTVLSCDLGAGTVRCRCENTATLGERKNVNLPGVVVDLPTLTEKDKEDILGWGVPNNIDMIALSFVRKGSDLVNVRKVLGSHAKRIQLMSKVENQEGVINFDEILRETDSFMVARGDLGMEIPVEKIFLAQKMMIYKCNLVGKPVVTATQMLESMIKSPRPTRAEATDVANAVLDGTDCVMLSGESAAGAYPEIAVKIMARICIEAESSLDYAAIFKEMIRSTPLPMSPLESLASSAVGTANKAKAKLIVVMTRGGTTAKLVAKYRPAVPILSVVVPLLTTDSFDWTCSDEAPARHSLIYRGLIPILAEGSAKATDAESTEVILEAALKSATGKGLCKPGDAVVVLHRIGVASVIKICIVK

SEQ ID NO: 2849 - protein, 488 aa, Vitis vinifera
MALSETASESNASIHSTFASRYVRVSLPRFKIPENSIPKEAAYQIINDELMLDGNPRLNLASFVTTWMEPECDKLIMASINKNYVDMDEYPVTTELQNRCVNMIAHLFNAPLGESEAAVGVGTVGSSEAIMLAGLAFKRKWQNKRKAEGKPHDKPNIVTGANVQVCWEKFARYFEVELKEVKLTDGYYVMDPVKAVEMVDENTICVAAILGSTLNGEFEDVKHLNDLLTKKNKETGWDTPIHVDAASGGFIAPFLHPELEWDFRLPLVKSINVSGHKYGLVYAGIGWVIWRSKEDLPDELIFHINYLGADQPTFTLNFSKGSSQVIAQYYQLIRLGHEGYRNIMENCQENARVLKEGLEKTGHFNIVSKENGVPLVAFSLKDNSCHNEFEVSDMLRRYGWIVPAYTMPPDAQHVTVLRVVIREDFSRTLAERLVTDIQKVLYELDTLPAKITAKVQQSNKKSEIETQREITEAWKKFVREKKKTNGVC

SEQ ID NO: 2850 - protein, 260 aa, Vitis vinifera
MAAAPSAREENVYMAKLAEQAERYEEMVEFMEKVSAAVDSEELTVEERNLLSVAYKNVIGARRASWRIISSIEQKEESRGNEDHVAMIRDYRSKIESELSSICDGILKLLDSRLIPSASSGDSKVFYLKMKGDYHRYLAEFKTGAERKEAAESTLTAYKSAQDIANAELAPTHPIRLGLALNFSVFYYEILNSPDRACNLAKQAFDEAIAELDTLGEESYKDSTLIMQLLRDNLTLWTSDMQDDGADEIKEAPKRDDEQQ

SEQ ID NO: 2851 - protein, 305 aa, Vitis vinifera
MPFCYNNNYCYFIKSKKIVITKLFRDLIQRLREIASIKGYNENTRRLLIYIRLKLLLPPHSKLKPSFQSAPWRLPYEKLTLTLQMALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDVNLHFVESPALAPPEVQIDMAAQAHHEAELAAAAAQPLPDDDDDTFE

SEQ ID NO: 2852 - protein, 332 aa, Vitis vinifera
MAKEPVRVLVTGAAGQIGYALVPMIARGVMLGADQPVILHMLDIPPAAEALNGVKMELVDAAFPLLKGVVATTDVVEACTGVNIAVMVGGFPRKEGMERKDVMSKNVSIYKSQASALENHAAANCKVLVVANPANTNALILKEFAPSIPEKNISCLTRLDHNRALGQVSERLNVQVSDVKNVIIWGNHSSTQYPDVNHATVKTPAGEKPVRGLVGDDAWLNGEFITTVQQRGAAIIKARKLSSALSAASAACDHIRDWVLGTPEGTWVSMGVYSDGSYNVPAGLIYSFPVTCCAGEWKIVQGLHIDEFSRKKLDLTAQELSEEKELAYSCLS

SEQ ID NO: 2853 - protein, 393 aa, Vitis vinifera
MASVTFAKFNASSSQWIGQQSFSQRQGSSARFPARRVSVPIRAGSYSEELVQTAKTVASPGRGILAIDESNATCGKRLASIGLDNTEPNRQAYRQLLLTTPGLGEYISGAILFEETLYQSTTDGKKFVDCLREKKIVPGIKVDKGLVPLPGSNNESWCQGLDGLASRSAEYYKQGARFAKWRTVVSIPCGPSALAVKEAAWGLARYAAISQDNGLVPIVEPEILLDGDHPIDRTLEVAEKVWSEVFFYLAQNNVLFEGILLKPSMVTPGAEHKEKASPETIAKYTLTMLRRRVPPAVPGIMFLSGGQSEVEATLNLNAMNQSPNPWHVSFSYARALQNTVLKTWQGHPENVEAAQKSLLVRAKANSLAQLGKYSAEGESEEAKKGMFVQGYTY

SEQ ID NO: 2854 - protein, 411 aa, Vitis vinifera
MNSQHPDGSVFSNIVRAPEDPILGVTVAYNKDTSPIKLNLGVGAYRTEEGKPLVLNVVRRAEQLLVNDPSRVKEYLPIVGLAEFNKLSAKLIFGADSPAIQENRVATVQGLSGTGSLRIGAEFLARHYYQHTIYIPVPTWGNHPKIFTIAGLSVKTYRYYDPETRGLDFKGLLEDLGAAPTGAIVLLHACAHNPTGVDPTLEQWEQIRQLMRSKGLLPFFDSAYQGFASGSLDADAQSVRMFVADGGECLAAQSYAKNMGLYGERVGALSIVCKAADVASRVESQLKLVIRPMYSNPPIHGASIVATILKDSDMYNEWTLELKAMADRIISMRQLLFDTLRDRGTPGDWSHIIKQIGMFTFTGLNTEQVAFMTKEYHIYMTSDGRISMAGLSSRTVPHLADAIHAAVTRIP

SEQ ID NO: 2855 - protein, 448 aa, Vitis vinifera
MREILHVQGGQCGNQIGSKFWEVICDEHGVDPTGRYNGDGSSDLQLERINVYYNEASGGRYVPRAVLMDLEPGTMDSIRSGPYGQIFRPDNFVFGQSGAGNNWAKGHYTEGAELIDAVLDVVRKEAENCDCMQGFQVCHSLGGGTGSGMGTLLISKMREEYPDRMMLTFSVFPSPKVSDTVVEPYNATLSVHQLVENADECMVLDNEALYDICFRTLKLSTPSFGDLNHLISATMSGVTCCLRFPGQLNSDLRKLAVNLIPFPRLHFFMVGFAPLTSRGSQQYISLTVPELTQQMWDAKNMMCAADPRHGRYLTASAMFRGKMSTKEVDEQMINVQNKNSSYFVEWIPNNVKSSVCDIPPRGLKMASTFVGNSTSIQEMFRRVSEQFTAMFRRKAFLHWYTGEGMDEMEFTEAESNMNDLVSEYQQYQDATADDEGEYEEGPEENYEA

SEQ ID NO: 2856 - protein, 445 aa, Vitis vinifera
MREILHIQGGQCGNQIGAKFWEVICDEHGIDNTGKYSGDSDLQLERINVYYNEASGGRYVPRAVLMDLEPGTMDSVRSGLFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPKGLKMASTFIGNSTSIQEMFRRVSEQFTAMFRRKAFLHWYTGEGMDEMEFTEAESNMNDLVAEYQQYQDATADEEYEEEEEEEEITA

SEQ ID NO: 2857 - protein, 495 aa, Vitis vinifera
MYKTLLGSQGFRKGMDLYFKRHDGQAVTCEDFFAAMRDANDADFANFLLWYSQAGTPLVKVTSSYNAEAHTYSLKFSQEVPPTPGQPVKEPMFIPVAVGFLDSTGKEMPLSSVYHDGTLQSVVSNDQPTYTTVLRVTKKEEEFLFSDISEKPIASLLRGYSAPIRLDTDLTDSDLFFLLAHDSDEFNRWEAGQVLARKLMLGLVADFQQNRPLVLNPKFVHGLKSILLDSSLDKEFIAKAITLPGEGEIMDIMEVADPDAVHAVRSFIRKQLASELRAELLSTVEKNRSSEDYVFNHPNMARRALKNVALGYLALLDDPELTELALHEYRTAANMTEQFAALAAIAQIPGKTRDDVLADFYSKWQQDFLVVNKWFALQAMADIPQNVENVRNLLNHPAFDLRNPNKVYSLIGGFCGSPVNFHAKDGSGYKFLGEMVVQLDKINPQVASRMVSAFSRWKRYDDTRKSLAKAQLEMIVACNGLSENVYEIASKSLAA

SEQ ID NO: 2858 - protein, 549 aa, Vitis vinifera
MLIWQLSNSEKVEHFLISFSIIPETTDFHHTVLSEFQRRPKPGDLFGSESMAKHEDLPVPVFSALEPVYGGGSQLEEAQLRFDGLKSKFVEVFGQAPDIFARSPGRVNLIGEHIDYEGYSVLPMAIRQDTIVAIRKHDAGESPKLLRIANVSDKYTMCTYPADPEQEIDLKNHKWGHYFICGYKGYYEYAKLKGVDVGVPVGLDVLIDGTVPTGSGLSSSAAFVCSSMIAIMAAYDVSFPKKDVAQLTCECERHIGTQSGGMDQAISIMAKSGFAELIDFNPVRATDVQLPAGGSFVIAHSLAESQKAVTAATNYNNRVVECRLAAIVLGIKLGMKPQQAIAEVKTLSDVEGLCVSFASDHGSSDPVVAVKEFLKEEPYTAEEIEKIIEESLPSVFGNSPTSLDVLKAAKHFKLFQRASHVYSEARRVHAFRDTVLSGLSEEDMLKKLGDLMNKSHDSCSVLYECSCPELEELVKICRDNGALGARLTGAGWGGCAVALVKESIVPQFILNLKDQFYQSRIEKGVINKNDLGLYIFASKPSSGAAIFKF

SEQ ID NO: 2859 - protein, 537 aa, Vitis vinifera
MFAWQRTAFHFQPEKNWMNDPDGPLFHMGWYHLFYQYNPDSAVWGNITWGHAVSRDMIHWLYLPLAMVPDRWFDLNGVWTGSATILPNGQIIMLYTGDTNDSVQVQNLAYPANLSDPLLLHWIKYENNPVMVPPAGIGSDDFRDPTTMWVGADGNWRVAVGSLVNTTGIVLVFQTTNFTDFELLDGELHGVPGTGMWECVDFYPVSINGVYGLDTSAHGPGIKHVLKASMDDNRHDYYALGEYDPMTDTWTPDDPELDVGIGLRLDYGKYYASKTFYDQVKKRRILYGWISEGDIESDDLKKGWASLQSIPRTVLHDNKTGTYLLLWPIEEVESLRTNSTEFEDVLLEPGSVVPLDIGSASQLDIVAEFEVDNETLEAMVEADVIYNCSTSAGAAGRGALGPFGILVLADDTLSELTPIYFYIAKDTDGSYKTFFCTDLSRSSLAVDDVDQRIYGSIVPVLDDEKPTMRVLVDHSIVEGFSQGGRSCITTRVYPTEAIYGAARLFLFNNATGVNVTASIKIWEMASADIHPYPLDQP

SEQ ID NO: 2860 - protein, 577 aa, Vitis vinifera
MEEADWSAVTGSCSGTLGGHLARRLVQIGVRDVFSVPGDFNLTLLDHLIAEPGLNLVGCCNELNAGYAADGYARARGVGACVVTFTVGGLSVLNAIAGAYSENLPVICIVGGPNSNDYGTNRILHHTIGLPDFTQELRSFQTVTCTQAVVNHLEDAHEQIDTAISTALKESKPVYLSISCNLPGIPHPTFSREPVPFFLAPKVSNQIGLEAAVEATADFLNRAVKPVIVGGPKLRVAKAQRALMELADASGYPIAVMPSGKGLVPEQHPHFIGTYWGAVSTTFCGEIVESADAYVFAGPIFNDYSSVGYSLLIKKEKAVIVEPNRVTVGNGPSFGWVFMADFLSALAKKLKKNETAVENYRRIYVPPGVPLRREEHEALRVNVLFKHIQDMLDGNSAVIAETGDSWFNCQKLRLPENCGYEFQMQYGSIGWSVGATLGYAQGAKDKRVIACIGDGSFQVTAQDVSTMIRCGQRTIIFLINNGGYTIEVEIHDGPYNVIKNWDYTALINAIHNGEGKCWTAKVRTEDELTEAIATATGAHKDSLCFIEVFVHKDDTSKELLEWGSRVSAANGRPPNPQ

SEQ ID NO: 2861 - protein, 667 aa, Vitis vinifera
MYGAWGLRASSVVLGILLVGCLVAISIAKEESNKLGTVIGIDLGTTYSCVGVYKNGHVEIIANDQGNRITPSWVAFTDTERLIGEAAKNQAAVNAERTVFDVKRLIGRKFDDKEVQKDMKLFPFKIVNKDGKPYIQVKIKDGETKVFSPEEISAMILTKMKETAEAFLGKTIKDAVVTVPAYFNDAQRQATKDAGIIAGLNVARIINEPTAAAIAYGLDKKGGEKNILVFDLGGGTFDVSILTIDNGVFEVLATNGDTHLGGEDFDQRIMEYFIKLIKKKHGKDISKDNRAIGKLRRESERAKRALSSQHQVRVEIESLYDGLDFSEPLTRARFEELNNDLFRKTMGPVKKAMEDAGLEKRQIDEIVLVGGSTRIPKVQQLLKEYFDGKEPNKGVNPDEAVAYGAAVQGSILSGEGGDETKDILLLDVAPLTLGIETVGGVMTKLIPRNTVIPTKKSQVFTTYQDQQTTVSIQVFEGERSLTKDCRELGKFDLSGIAPAPRGTPQIEVTFEVDANGILNVKAEDKASGKSEKITITNDKGRLSQEEIDRMVREAEEFAEEDKKIKEKIDARNSLESYVYNMKTQINDKDKLADKLESEEKEKIETAVKEALEWLDDNQNAETEDYQEKLKEVEAVCNPIITAVYQRSGGAPGGSSDAGEDEDSHDEL

SEQ ID NO: 2862 - protein, 662 aa, Vitis vinifera
MAQKRFIIEMEKAKEAKDGRPSIGPVYRSSFARDGFPKPIEGMESCWDVFRLAVEKYPGNRMLGQREIVNGKAGKYVWLTYKEVYDKVMKVGNSIRSCGVNEGGRCGIYGANSAEWIMSMEACNAHGLYCVPLYDTLGAGAVEFIICHSELSIVFVEEKKIPEVLKTFPNTTEYLKTIVSFGKVTPEQREEVEKFGLAIYYWEEFLQLGDDKKFDLPLTKKNDICTIMYTSGTTGDPKGVMISNESIVTLIAGVKRLLQSVNEELNEKDVFISYLPLAHIFDRVIEELFISHGASIGFWRGDVKLLVEDIGELKPTIFCAVPRVLDRIYSGLKQKISAGGLLRNTLFNIAYKYKQYNLWKGVKTLEAAPICDKIVFGKVKQGLGGNVRLILSGAAPLSTHVEAYLRVVTCAHVLQGYGLTETCAGTFVSLPNEISMLGTVGPPVPNVDVCLESVPEMGYDALSSTPRGEICIRGKTLFSGYYKREDLTKEVLVDGWFHTGDVGEWQPDGSMKIIDRKKNIFKLSQGEYVAVENLENIYGLVSDIDSIWIYGNSFESFLVAVANPNQQALERWAKENNISGDFDSLCENPKAKEYILGELSKIGKEKKLKGFEFVKAVHLDPVPFDMERDLITPTYKKKRPQLLKYYQNVIDKMYKSINKPSA

SEQ ID NO: 2863 - protein, 767 aa, Vitis vinifera
MGSTILSDLATEIVVPVCAVIGIVFSLIQWFLVSRIKVSPDRHSSSSNNGKGAGYGDYLIEEEEGLNDHNVVVKCAEIQSAISEGATSFLFTEYQYVGVFMVAFAILIFLFLGSVNGFSTKSQVCTYNPQEMCKPALATAIFSTVSFMLGAVTSVISGFLGMKIATYANARTTLEARKGVGKAFIVAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSMGILVCLITTLFATDFFEIKAVKEIEPALKKQLIISTVLMTVGVAIVSWIALPSSFTIFNFGSQKVVKNWQLFLCVGVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLLVGAMLPYWFSAMTMKSVGSAALKMVEEVRRQFNTIPGLMEGLAKPDYATCVKISTDASIKEMIPPGALVMLTPLIVGTFFGVETLSGVLAGSLVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 2864 - protein, 963 aa, Vitis vinifera
MANRNIEKMASIDAQLRLLVPAKVSEDDKLVEYDALLLDRFLDILQDLHGEDLKETVQECYELSAEYEGKHDPKKLEELGNVLTSLDAGDSIVIAKSFSHMLNLANLAEEVQIAYRRRNKLKKGDFADENNATTESDIEETLKKLVVQLKKSPEEVFDALKNQTVDLVLTAHPTQSVRRSLLQKHGRIRNCLAQLYAKDITPDDKQELDEALQREIQAAFRTDEIRRTPPTPQDEMRAGMSYFHETIWKGVPKFLRRVDTALKNIGINERVPYNAPLIQFSSWMGGDRDGNPRVTPEVTRDVCLLARMMAANLYYSQIEDLMFELSMWRCNDELRVRADELLRSSKKDAKHYIEFWKQIPPSEPYRVILGEVRDKLYQTRERSRHLLAHGISDIPGEATYTNLEQFLEPLELCYRSLCACGDRPIADGSLLDFLRQVSTFGLSLVRLDIRQESDRHTDVIDAITRHLEIGSYREWSEERRQEWLLSELSGKRPLFGPDLPKTEEIADVLDTFHVIAELPADNFGAYIISMATAPSDVLAVELLQRECHVKQPLRVVPLFEKLADLEAAPAAVARLFSIDWYKNRINGKQEVMIGYSDSGKDAGRLSAAWALYKAQEELIKVAKQYGIKLTMFHGRGGTVGRGGGPTHLAILSQPPDTIHGSLRVTVQGEVIEQSFGEEHLCFRTLQRFTAATLEHGMHPPISPKPEWRALMDEMAVVATENYRSIVFQEPRFVEYFRLATPELEYGRMNIGSRPSKRKPSGGIESLRAIPWIFAWTQTRFHLPVWLGFGGAFKYAIEKDIRNLHLLQEMYNEWPFFRVTIDLVEMVFAKGDPGIAALYDKLLVSKDLWSFGERLRSNYEQTKSLLLQIAGHKDLLEGDPYLKQRLRLRDSYITTLNVCQACTLKRIRDPSYDVKVRPHICKDIMESAAQELVNLNPTSDYGPGLEDTLILTMKGIAAGMQNTG

SEQ ID NO: 2865 - protein, 162 aa, Vitis vinifera
MASAEIEYRCFVGGLAWATDDQSLERAFSQFGEILESKIINDRETGRSRGFGFVTFSSEQSMRDAIEGMNGQNLDGRNITVNEAQSRGSGGGGGGGGGGGGYRGGGGYGGGGRREGGYSRGGGGGYGGGGGGYGGGSRDRGYGDGGSRYSRSGGASDGNWRN

SEQ ID NO: 2866 - protein, 158 aa, Vitis vinifera
MGVFTYEQEITSSVPPAKMFKAAVLDADNLIPKVRPQAIKCVEVIQGDGGPGTIKKIHFGEGHKFKSMTHRVDAIDKEKFSFCYTVIDGDVLTDGVESICHELTVVPAPGGGSIYKNTSKYHTKGAEVCEEHVKGGKEDALATFKAIEAYVLAHPDAY

SEQ ID NO: 2867 - protein, 198 aa, Vitis vinifera
MKRKEKSQPKNDTRFISDSLQLESSPEGTWNRMALVTTAEVCDANPQLIVSGELRALQPVFQIYGRRPVFSGPIVTLKVFEDNVLIREFLEEKGNGRVLVVDGGGSMRCAILGGNPVVQAQNNGWAGIVVNGCIRDVDEINGCDIGVRALNSHPMKANKKGIGEKHVPIAIAGTRISDGEWLYADTDGILISRTELSV

SEQ ID NO: 2868 - protein, 199 aa, Vitis vinifera
MGSFKDDREEVLQAWYMDDSDEDQRLPHHRDPKEFVSLDQLAKLGVLSWRLDADNYETDEELKKIREARGYSYMDFCEVCPEKLPNYEEKIKNFFEEHLHTDEEIRYCVAGSGYFDVRDQNDSWIRVWLKKGGMIVLPAGIYHRFTLDSNNYIKAMRLFVGDPVWTPFNRPHDNLPARQEYLEAFGQKEAANHVVDAAA

SEQ ID NO: 2869 - protein, 220 aa, Vitis vinifera
MANSPVVWLASVCLVFNILSLPFLALGLSSCGGSCQTLNDCEGQLICINGKCNDDPEVGTHICGGNSSTPSPPSPSTCQPSGTLACKGGKPKNTYTCSPPVTSSTPAVLTNNNFEKGGDGGGPSACDNKYHDNSERIVALSTGWYNGGSRCGKMIRITAQNGRSVLAKVVDECDSMHGCDKEHAGQPPCDNNIVDGSNAVWNALGLDINIGEVDVTWSMA

SEQ ID NO: 2870 - protein, 252 aa, Vitis vinifera
MASTLPENLTREQYVYLAKLAEQAERYEEMVKFMEKLVIGWTSMSELTVEERNLLSVAYKNVIGSLRAAWRIVSSIEQKEESRKNEEHVALVKDYRSTVETELSEVCAGILKLLDSHLIPSASTSESKVFYMKMKGDYHRYLAEFKVGNEKKDAAEETMLAYKSAQDIALADLAPTHPIRLGLALNFSVFYYEILNSSDKACSMAKQAFEEAIAELDTLGEESYKDSTLIMQLLRDNLTLWTSDAQDQLDEP

SEQ ID NO: 2871 - protein, 287 aa, Vitis vinifera
MEGKEEDVKLGANKFTERQPLGTAAQTDKDYKDLPPAPLFEPGELKSWSFYRAGIAEFMATFLFLYITILTVMGVKKSPTMCASVGIQGIAWAFGGMIFALVYCTAGISGGHINPAVTFGLLLARKLSLTRAIFYIIMQCLGAICGAGVVKGFEGSQSYEVLGGGANVVNSGYTKGDGLGAEIVGTFVLVYTVFSATDAKRNARDSHVPILAPLPIGFAVFLVHLATIPITGTGINPARSLGAAIIFNREHAWDDMWIFWVGPFIGAALAAMYQQIVIRAIPFKSRA

SEQ ID NO: 2872 - protein, 356 aa, Vitis vinifera
MSLLADLQNINLSDSTEKIIAEYIWIGGSGNDLRSKARTLSGPVTGPAQLPKWNYDGSSTGQAPGEDSEVILYPQAIFKDPFRGGDNILVMCDAYTPGGEPIPTNKRFNAAKIFSHPEVTAEEPWYGIEQEYTLLQKDVNWPLGWPVGGFPGPQGPYYCGIGADKAFGRDIVDAHYKACLYAGINISGINGEVMPGQWEFQVGPAVGISAGDELWVARYILERITEIAGVVVSFDPKPIKGDWNGAGAHTNYSTKSMRNTGGYDVIKKAIEKLGLRHKEHISAYGEGNERRLTGRHETADINTFCWGVANRGASIRVGRDTEKEGKGYFEDRRPASNMDPYVVTSMIAETTILWKP

SEQ ID NO: 2873 - protein, 358 aa, Vitis vinifera
MELNLAPKFAQKIFEGEGGTYYSWSSAEYELLKEAKVGGGRLVLGPRGFALPHYADSNKIGYVLQGSCGVVGMVFPEASEEVVLKLKEGDIIPVPSGAVSWWYNDGDSELVIVFLGETSKAYVPGEFTYFLLTGTQGILGGFSTEFNSRAYNISNEEAEKLAKSQTGVLLIKLPEGQKMPHPCKNSTDKLVYNIDAALPDIHVQNAGLLTALTAKKFPFLGEVGLSATLVKLDANAMSSPVYAADSSVQVIYVAKGSGRIQVVGINGERALDTKVKAGHLYVVPRFFVASTIADGEGMEYFSLITATQPVFGEFTGKTSVWGALSPQVLQASLNVAPEFEQLFRAKIKKSTILVPPQN

SEQ ID NO: 2874 - protein, 365 aa, Vitis vinifera
MGKGGMSQGGDGRGEGEENMAAWLLGVNNLKIQPFILPPLGPHDVRVRMKAVGICGSDVHYLKKLRCADFIVKEPMVIGHECAGIIDEVGPQVKSLVPGDRVALEPGISCWRCQLCKEGRYNLCPEMKFFATPPVHGSLANQVVHPADLCFKLPDNVSLEEGAMCEPLSVGVHACRRADIGPESNVLVMGAGPIGLVTMLAARAFGAPRIVIVDVDDYRLSVAKDLGADEIVKVSTNIQDVAEEVVQIHKAMGARVDVSFDCAGFDKTMSTALSATSTGGKVCLVGMGHNEMTVPLTPAAAREVDVVGVFRYKNTWPICIEFLRSVKIDVKPLITHRFGFSQREVEEAFETSARGGTAIKVMFNL

SEQ ID NO: 2875 - protein, 376 aa, Vitis vinifera
MDFDEKQAVVCDNGSGLVKAGFAGDDAPCVVFPSVIGWPRNKHAMIGIGQKEMYLGDEAQARRGVLRLSYPINHGMVRDWEAMERLWQHTFEKELRVSIEERPVLLTEPPLNPKFNKEKMVEIMFEAFEIPATYVAIQAVLSLYASGRTTGIVMDSGEGVTHVVPIYEGYALPHAIQRLDLAGRDLTDYLTKILTEEGYVFTTSADREIVKDIKEQTTYVAMDFEKELATSRESLELDKQYELPDGQVITIGTGRFKCPEILFDPSKVGIESCGVHDIVLKSIRRCDMDIRRDMYGNVVLSGGTTMVPGLADRLAKELSSLAPPGVRVRVVAPPERKYSVWIGGSILASLSTFEQMWIKKEEYMESGSSIVHMKCF

SEQ ID NO: 2876 - protein, 405 aa, Vitis vinifera
MAAAARPLVTVQVLKSDMATDGGNAVPLPDVMKASIRPDIVNFVHSNISKNSRQPYAVSRRAGHQTSAESWGTGRAVSRIPRVPGGGTHRAGQGAFGNMCRGGRMFAPTKIWRRWHRKINVNQKRYAVVSAIAASAVPSLVMARGHRIESVPELPLVIGDSAESVEKTSAAIDILKQVGAYPDAEKAKDSHGIRPGKGKMRNRRYISRKGPLIVYGTEGAKLVKAFRNIPGVEVANVERLNLLKLAPGGHLGRFIIWTKSAIEKVDSIYGSFDKTSEKKKGYLLPRAKMVNADLARIINSDEVQSVVRPIKKEVKRAPMKKNPLKNLNTMLKLNPYAKTARRMALLAEAQRVKAKKEKLDKKRAQIPKEEAAAIKAAGKAWYQTMISDSDYTEFDNFSKWLGVSQ

SEQ ID NO: 2877 - protein, 482 aa, Vitis vinifera
MARLILPCKGSGLARTGLLGLISSAPLQAPCCVSSLKHSAKNISRYRQSLNLEVSHRRNYRFPHPSLYRAKQVSRRFVCSVATESSPKQVEESKMDMPKEIFLKDYKLPDYYFDTMDLNFLLGEEKTTVYSKITVLPRVEGSPFPLVLDGVDLKLVSVKVNSKELKEEDYVLSPRHLTLPSLPSGEFTLEIVTEICPQKNTSLEGLYKSSGNFCTQCEAEGFRKITFYQDRPDIMAKYTCRIEGDKSLYPVLLSNGNLIEHGDLEGGKHYAIWEDPFKKPCYLFALVAGQLESRDDTFVTRSGRTVSLRIWTPAQDVPRTVHAMYSLKAAMKWDEDVFGLEYDLDLFNIVAVPDFNMGAMENKSLNIFNSKLVLASPETATDADYAAILGVIGHEYFHNWTGNRVTCRDWFQLSLKEGLTVFRDQEFSSDMGSRTVKRIADVSRLRNYQFPQDAGPMAHPVRPHSYIKMDNFYTGKFVFSVI

SEQ ID NO: 2878 - protein, 492 aa, Vitis vinifera
MDPYKYRPSSAYNSPFWTTNSGAPVWNNNSSLTVGPRGPILLEDYHLVEKLANFDRERIPERVVHARGASAKGFFETTHDISNLTCADFLRAPGVQTPVILRFSTVIHERGSPETLRDPRGFAVKFYTREGNFDLVGNNFPVFFIRDGMKFPDMVHALKPNPKSHIQENWRIVDFFSHHPESLHMFSFLFDDVGIPQDYRHMEGSGVNTYTLINKAGKAHYVKFHWKPTCGVKCLLEEEAIRVGGSNHSHATQDLYDSIAAGNYPEWKLFIQTIDPDHEDKFDFDPLDVTKTWPEDILPLQPVGRLVLNRNIDNFFAENEQLAFCPAIVVPGVYYSDDKLLQTRIFSYSDTQRHRLGPNYLQLPANAPKCAHHNNHHEGFMNFMHRDEEVNYFPSRYDPVRHAERYPIPPAILTGRREKCIIPKENNFKQPGERYRSFAPDRQERFIQRWVDALSDPRVTYEIRSIWISYWSQADKSLGQKLASRLNVRPSI

SEQ ID NO: 2879 - protein, 492 aa, Vitis vinifera
MDPYKYRPSSAYNSPYFTTNAGAPVYNNDSSLTVGSRGPVLLEDYHLVEKLANFQRERIPERVVHARGASAKGFFEVTHDVSDLTCADFLRAPGVQTPVIVRFSTVIHERGSPETIRDPRGFAVKFYTREGNFDMVGNNFPVFFIRDAMKFPDVIHAFKPNPKSHIQEYWRVVDFLSYHPESLSTFAFLFDDVGVPQDYRHMEGFGVHTFTLINKAGKANYVKFHWKPTCGVKCLLEDEAIRVGGTNHSHATQDLYDSIKAGNYPEWKLFIQTMDPEHEDKFDFDPLDVTKTWPEDILPLQPVGRLVLNKNIDNFFAENEMLAFNPALVVPGIYYTNDKMLQGRIFAYSDTQRHRLGPNYLQLPVNAPKCAFHNNHHDGSMNFMHRDEEVDYFPSRFDPVRHAETFPIPSTICHGKREKVVIEKENNFKQPGERYRSFAPDRQERFINRWVETLSDPRVTYEIRSIWISYWSQADRSLGQKLASRLNVKPKY

SEQ ID NO: 2880 - protein, 519 aa, Vitis vinifera
MGFGEKWLGWIKWCISTASFSVLINGTPKGFFQSSRGLRQGDPLSPYLFVIAMEVFSSFLNRAVDNVKEISAPEDIEGPEDAEGYKKRHLNVVFIGHVDAGKSTTGGQILFLSGQVDDRTIQKYEKEAKDKSRESWYMAYIMDTNEEERVKGKTVEVGRAHFETETTRFTILDAPGHKSYVPNMISGASQADIGVLVISARKGEFETGYERGGQTREHVQLAKTLGVSKLLVVVNKMDDPTVNWSKERYDEIESKMIPFLRSSGYNVKKDVHFLPLSGLVGLNMKTRVDKSLCSWWNGPCLFEALDAIDVPFRDPKGPFRMPIIDKFKDMGTVVMGKVESGSVREGDSLLVMPNKVQVKVFAVYCDENKVKLAGPGENVRVRLSGIEEEDIISGFVLSSIAKPIPAVYEFVAQLQILELLDNAIFTAGYKAVLHIHSIVEECEIIELLQQIDPKTKKPMKKKVLFVKNGAVVLCRIQVNNLICIEKFSDFPQLGRFTLRTEGKTVAMGKVMDLNSASSI

SEQ ID NO: 2881 - protein, 554 aa, Vitis vinifera
MASRKLLSSLLRTSVRRPISRSVLSNPRSPLPRPSPVGHLLARAANYASSASAAAPAASTPSAAKGAGPSGKITDEFTGAGAIGQVCQVIGAVVDVRFDEGLPPILTALEVLDNSIRLVLEVAQHLGENMVRTIAMDGTEGLVRGQRVLNTGSPITVPVGRATLGRIINVIGEPIDERGDIKTDHFLPIHREAPSFVDQATEQQILVTGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEVFTGAPGKYVELKESITSFQGVLDGKYDDLSEQSFYMVGGIEEVIAKAEKIAKESAA

SEQ ID NO: 2882 - protein, 697 aa, Vitis vinifera
MEAPPVVPPAPPLSSGLGVGVGGPHMSYPDSVDSSPRSRNTDSWDDPLPSVPGAKLRLMCSYGGHIFPRPHDKSLCYVGGDTRIVVADRNSSLADLSARLSKILLQGRSFTLKYQLPNEDLDSLISVTTDEDLENMIDEYDRTSALKPSRLRLFLFPNKPESASSIGSILDNSTKSDDWFLNCLNGTNLMTRGFSDSASVNCLLSLDEDAVANNLDSSSARDLEASQPGGFGTCKTVKQGQDVHSVPDSPMLETSSSFGSTSSSPSLANLPPIRVHVEDGSGGGSVRLQDQKLGIEEQFAQMSVAMQKQDEGFVVLSSPATAGAAVPVMAGGDYPNRVFSDDERSDQGMPVGYRKPPPPQPQQQPLPPQSQQKSVGGIDLASPDSVSSDNSIPNAISRPKPMIYQEPVIQIPSGTNRVSSNPVEQNINLFDPNSRIHMQQPVQDSGYILAPQFDQQQQQQQQQQHQQQQQHQQQQQQQPQPQPQFIHAGTHYIHHHPTGPLQVPSFYPVYPSQQQHHHHHPHQLDPQYPMYFVPSRQAQAYSLSMQQSNFSEAATGIPSGRSQAPSAPAMVTSPAAYNPTRNAPLQKPEMAAGMYRTGTAAAPLVQVPSSQHQQQYVGYSQIHHPSQSIAPPSAATANYAYEFSDPAHAQIFYAQAMAPTLPQYQTMTSAPAVVVPEASAQLSTDNIKQQIRTSQPL

SEQ ID NO: 2883 - protein, 740 aa, Vitis vinifera
MNGAVLVAIAAAIGNFLQGWDNATIAGAIVYIKKELDLESTVEGLVVAMSLIGATLVTTCSGAISDWIGRRPMLIVSSMLYFISGLIMLWSPNVYVLLIARLLDGFGIGLAVTLVPIYISETAPADIRGSLNTLPQFTGSGGMFLSYCMVFGMSLLSSPSWRLMLGILSIPSLLYFALTVFYLPESPRWLVSKGRMVEAKKVLQRLRGREDVSAEMALLVEGLGIGGETSIEEYIIGPTGELTEDQDPDAVKDQIKLYGPEAGLSWVAKPVPGGQSTLSLVSRQGSLATQTLPLMDPLVTLFGSVHEKLPETGSMRSMLFPNFGSMFSTADPQIKTEQWDEESLQREGEDYASDGGGDSDHDLQSPLISRQTSSMEKDMVPPPSHSSIMSMRRHSSLMQGTAGEAAGGMGIGGGWQLAWKWSEREGEDGKKEGGFKRIYLHEEGVPGSRRGSLVSLPGGDVPAEGDYIQAAALVSQPALYSKELMDQDPVGPAMVHPAETASRGPMWAALLEPGVKHALFVGAGIQILQQFSGINGVLYYTPQILEEAGVEVLLESLGLGTESASFLISAFTTLLMLPCIVVAMKLMDIVGRRRLLLTTIPVLIVTLLVLVIGDLVTTTTVIHAAISTACVIIYFCCFVTAYGPIPNILCSEIFPTRVRGLCIAICALVYWIGDIIVTYTLPVMLTSIGLTGIFGIYAVVCVISWVFVFLKVPETKGMPLEVIAEFFAVGARQVTAAKND

SEQ ID NO: 2884 - protein, 848 aa, Vitis vinifera
MSVVGFDFGNESCIVAVARQRGIDVVLNDESKRETPAIVCFGDKQRFIGTAGAASTMMNPKNSISQMKRLIGRQFSDPELQQDLKSLPFTVTEGPDGYPLIHARYLGEVRTFTPTQVLGMMFSNLKGIAEKNLNAAVVDCCIGIPVYFTDLQRRAVLDAATIAGLHPLRLLHETTATALAYGIYKTDLPENDQLNVAFVDIGHASMQVCIAGYKKGQLKILAHSFDQSLGGRDFDEVLFNHFAAKFKEEYKIDVFQNARACLRLRSACEKLKKVLSANPVAPLNIECLMDEKDVRGFIKRDEFEQISVPILERVKGPLEEALSDAGLSAENIHAVEVVGSGSRVPAIIRILTEFFGKEPRRTMNASECVAKGCALQCAILSPTFKVREFQVNESFPFTIALTWKGDAQNGAADNQQNTVVFPKGNPIPSVKALTFYRSGTFSVDVVYADASEIQGQVKISTYTIGPFQSTKVERAKLKVKVRLNLHGIVSVESATLLEEEEVEIPVVKEPAKDATKMDTDETPGDAAAPPGTSETDANMQDAKGDAPGVENGVPESGDKSVQMETDTKVEVPKKKVKKTNIPVSELVYGTMVPADVQKAVEKEFEMALQDRVMEETKDKKNAVEAYVYDMRNKLHDKYQDFVTSSERDEFTAKLQEVEDWLYEDGEDETKGVYIAKLEELKKQGDPIEERYKEYSERGTVVDQLVYCINSYREAAMSNDPKFEHIDVSEKQKVLSECVEAEAWLREKKQQQDSLPKHATPVLLSADVRRKAEAVDRACRPIMTKPKPAKPAAPETPPTPPPQGNEPQPQGGENAASAHDSAADGSSSEVPPAAAEPMDTDKSETTTAA

SEQ ID NO: 2885 - protein, 873 aa, Vitis vinifera
MAAPPSSSATASIMLAIYEKKTVTVELYRPLRQYIAFTYSEREAQNLEDDLQALKQMRSDLERPGDSLPTRRDLLQSYFKALCLVESRFPISPDRDHINSITFTWYDAFKQKQKASQQNIHLEKAAVLFNLGAVYSQLGLFYDRSSVDGMRQAAQAFIAAAGAFAFLRDNAAMKASIGSSTTVDVSVECAGMLERLMLAQAQECVFENTIAKGSTPMVCTKIARQVGLYYEETFAALNVAPLNQHFDKTWISHIQLKAALFYGEACYRYGLELHQKEEIAEEIARLKSGISALSEAKKSSKGAAAQILDTITKLETNLNRNLERAVKENDRVYLMRVPSPSTLPPLPAFSMVKSMPMNEVLDASKERMFSSLVPDSSAKALSRYTEMVDDIIRTQAEKLQQGSELARVRLKEMDLPDSILALEGNFTLPTDLKEDVEAVQICGGPAGLEAELQQLMDLRRVNQELLVQTDELLQKEAREDGQFRSQFGTRWTRPQSSTLTKNLQDRLNRFAANLKQASESDARIERSVREHMALMSILDRRPIESALPTLARPIMSLDANEDAIVGALKQSLRQLETLGAQRAGLEDMLKEMKRKDDILPKLMTSTGSYEDLFRKEIAKYDNICEDIAQNLEAQEQLLLQIQAQNDEFAAIFNLEDYKASREKSYKQIAAAIAKFREIKENINEGLKFYVTLQDAITNIKQQCSDFVMTRNIQCREMIEDVQRQMAGLSFQDGKNTGAYNYPSVSQPHQTQRATSQQQTEPVNMTHPSRPQAPYYQPPPPEQPTMPGYAHSLPPYGSTQQPPPPYHVAGGPYHPQQAQQPPPSHEYGQPAYPGWRGPYYNNAHAQQPGSLPRPPYTIPAPYPPHHQSGYYKQQ

SEQ ID NO: 2886 - protein, 167 aa, Vitis vinifera
MLVYQDLLTADELLSDSFPYKELFNGALWEVEGKWVVQGAIDVDIGANPSAEGGEEEGVDDQTVKVVDIVDTFRLQEQPPFDKKQFVTYMKRYIKLLTPKLEGEKQEEFKKNIEGATKFLLSKLSDLQFFVGESMHDDGSLVFAYYKDGATDPTFLYFGHGLKEIKC

SEQ ID NO: 2887 - protein, 180 aa, Vitis vinifera
MPHPCKNSTDKLVYNIDAALPDIHVQNAGLLTALTAKKFPFLGEVGLSATLVKLDANAMSSPIYAADSSVQVIYVAKGSGRIQVVGINSERALDTKVKAGHLCVVPRFFVASVIADGEGMEYFSMITTTQPVFGEFTGKTSVWGALSPQVLQASLNVGPEFEQLFRAKIKKSTILVPPQN

SEQ ID NO: 2888 - protein, 190 aa, Vitis vinifera
MGYWKSKVLPKIKKIFEKSGTKKTAAAEACKSFDDSKEEINKDFEAKKDELQPKVIEIYEASSTEIKTLVKEPKEAGLKNSTAVQKFLDELVKIEFPGSKAVCEASSKYGPGLVSGPVLFLFEKVSTFIVTEENEEELPPPTTNTTGEEEASGKEKEIVIEEEKKEEVAVMVEEREATEAVAAAAEPAKP

SEQ ID NO: 2889 - protein, 206 aa, Vitis vinifera; identical to SEQ ID NO: 491

SEQ ID NO: 2890 - protein, 236 aa, Vitis vinifera; identical to SEQ ID NO: 508

SEQ ID NO: 2891 - protein, 249 aa, Vitis vinifera
MLAVFHKSIAEAPEGLRTPDSASLPALKDGFLPQFFASLHPSAVTVNLGSSGAISYSVDKQNPLLPRLFAVVDDIFCLFQGHIENVALLKQQYGLNKTANEVIIVIEAYRTLRDRGPYPADQVVRDLHGKFAFVLYDSSNRTAFLAADADESVPFFWGVDSEGHLVLSDDEETVKKGCGISFAPFPKGCFFTTSGGLRSFEHPLNELRAEPRVDSSGQVCGANFKVDVEAKKETGMPRVGSAANWSTHY

SEQ ID NO: 2892 - protein, 273 aa, Vitis vinifera
MAERGGGGERGGFGRGFGRGGRGDRGRGGRRRSAGRREEEEKWVPVTKLGRLVKDGKIRTVEEIYLHSLPIKEHQIIDTLVGPSLKDEVMKIMPVQKQTRAGQRTRFKAFVVVGDGNGHVGLGVKCSKEVATAIRGAIILAKLSVIPVRRGYWGNKIGKPHTVPCKVTGKCGSVTVRMVPAPRGAGIVAARVPKKVLQFAGIEDVFTSSRGSTKTLGNFVKATFDCLLKTYAYLTPDFWRETRYTKSPFQEHTDLLAKPTKAIYQDDVERVEA

SEQ ID NO: 2893 - protein, 284 aa, Vitis vinifera
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAVKALGSFRSTTHV

SEQ ID NO: 2894 - protein, 306 aa, Vitis vinifera
MSEKSKILIIGGTGYIGKFIVAASARSGHPTFALVRESTVSNPSMSEIIESFKSSGVTLVYGDLHDHESLVKAIKQVDVVISTVGRAQFSDQVKIIAAIKEAGNVKRFFPSEFGNDVDRIHAVGPAKTAFGIKAQIRRAIEAEGIPYTYLEATAAFFVSRLSQPGATGPPRDKIIIPGDGNPKAVFNKEDDIGTYTIKAVDDPRTLNKNLYVRPPQNTYSYNEIVSLWEKKIGKTLEKIYVPEEQVLKNIQEASAPLNAILSIDHSVFIKGDQTNFEIEPSFGVEASELYPDVKYTTVDELLNQLV

SEQ ID NO: 2895 - protein, 316 aa, Vitis vinifera
MSAFYGPPKPEEDMIALIHHAVNSGITLLDTSDMYGPFTNEILLGKALKGGVREKVELASKFGIIYADGKRDVRGDPAYVRAACEASLKRLEVDCIDLYYQHRIDTRVPIEVTIGELKKLVEEGKIKYIGLSEASASTIRRAHAVHPITAVQLEWSLWTRDVEEEIVPTCRELGIGIVAYSPLGRGFFSSGTKLIENLSNNDFRKNLPRFQPENLGHNKILYERVSEIATRKGCTPSQLALAWVHHQGDDVCPIPGTTKIENLKQNIGALSVKLTPEEMAELESIASADGVKGDRYESTAFTWKTADTPPLDSWKA

SEQ ID NO: 2896 - protein, 345 aa, Vitis vinifera
MAKEVSNGDHNSVTKPPPTPSPLRNSKFFQSNMRILVTGGAGFIGSHLVDKLMQNEKNEVIVADNYFTGSKDNLRKWIGHPRFELIRHDVTEPLLIEVDQIYHLACPASPIFYKYNPVKTIKTNVIGTLNMLGLAKRVGARILLTSTSEVYGDPLVHPQEESYWGNVNPIGVRSCYDEGKRVAETLMFDYHRQHGIEIRIARIFNTYGPRMNIDDGRVVSNFIAQAIRGESLTVQAPGTQTRSFCYVSDMVDGLVRLMEGDNTGPINIGNPGEFTMLELAETVKELINPKVEISMVENTPDDPRQRKPDITKAKELLGWEPNVKLREGLPLMEEDFRLRLGVAKN

SEQ ID NO: 2897 - protein, 379 aa, Vitis vinifera
MALLSDLINLNLSETTEKVIVEYIWVGGSGMDLRSKARTLSGPVSDPAKLPKWNYDGSSTGQAPGEDSEVILYPQAIFKDPFRRGNNILVMCDTYTPAGEPIPTNKRCNAAKIFSHPDVAAEVPWYGIEQEYTLLQKEVKWPIGWPVGGFPGPQGPYYCGIGADKAWGRDIVDAHYKACLYAGINISGINGEVMPGQWEYQVGPSVGISAGDELWVSRYILERITEIAGVVLSFDPKPIQGDWNGAGAHTNYSTKSMRNDGGFEVIKKAIEKLGLRHKEHIAAYGEGNERRLTGRHETADINTFLWGVANRGASIRVGRDTEKKACFKHGSLCGHLHDCRNYHPLEAIRHPSPPSQQACGIVLLEFPVKIVSLELLVLV

SEQ ID NO: 2898 - protein, 397 aa, Vitis vinifera
MENLRRRRMSHRKFEHPRHGSLGFLPRKRAARHRGKVKAFPKDDPSKPCRLTAFLGYKAGMTHIVREVEKPGSKLHKKETCEAVTIVETPPMVIVGVVAYVKTPRGLRSLNTVWAQHLSEEVKRRFYKNWCKSKKKAFTKYSKQYETEEGKKSIQAQLEKMKKYASVIRVLAHTQIRKMKGLKQKKAHLMEIQVNGGTIAQKVDYAYGFFEKQVPVDAIFQKDEMIDIIGVTKGKGYEGVVTRWGVTRLPRKTHRGLRKVACIGAWHPARVSFTVARAGQNGYHHRTEMNKKIYKLGKIEQESHTALTEFDRTEKDITPMGGFPHYGVVKDDYVMIKGCCVGPKKRVVTLRQSLLKQTSRVALEEIKLKFIDTSSKFGHGRFQTTQEKQKFYGRMKA

SEQ ID NO: 2899 - protein, 429 aa, Vitis vinifera
MALRHLTPLSPLSPFTRIPPRRCFTQKPFSLSVSASMGSSSRKVLVPIAHGSEPMEAVIIIDVLRRAGADVTVASVEKRLQVDACHGVKIVADALISDCADTGFDLISLPGGMPGAATLRDCGMLESMVKKHAADGQLYAGICAAPAVALGSWGLMKGLKATCYPSFMEQLSSTATTVESRVQQDGKVVTSRGPGTTMEFSVSLVEQLYGKEKANEVSGPLVMCSNLGDKFIMAELNPIDWKCDNPQILVPIANGTEEMEAVIIIDFLRRAKANVVVASVEDKLEIVASRKVKLVADVLLDEAVKLSYDLIVLPGGLGGAQAFASSEKLVNLLKNQRESNKPYGAICASPALVLEPHGLLKGKKATAFPALCSKLSDQSEIENRVLVDGNLITSRGPGTSMEFALAIIEKFFGHGKALELAKVMLFSSQ

SEQ ID NO: 2900 - protein, 473 aa, Vitis vinifera
MWAIVRRKVASGSSAASVLGQSLSKIRPAAASVPRGYTTTAKEALLLGGGSKIIRNVGHYKYLGSLVSSKPVREVTSFLQIDSPIQVQHRPFSSDKGDLVDAVVPFMGESISDGTLAKFLKKPGDHVEVDEPIAQIETDKVTIDVASPEAGVVQKFVAKEGDVVEPGTKIAVISKSGEGVTHVAPSEKTPSKASPEPSPTEKEAVDKPKPKSETPPPKEKPKAPAPPPPRPSATEPVLPPKERERRVPMTRLRKRVATRLKDSQNTFAMLTTFNEVDMTNLMKLRSDYKDAFLEKHGVKLGLMSGFIKAAVSGLQNQPIINAVIDGDDIIYRDYIDISIAVGTPKGLVVPVIRNADGMNFADIEKAINTLARKANDGTISIDEMAGGSFTISNGGVYGSLLSTPIINPPQSAILGMHSIVNRPMVVGGNVVSRPMMYIALTYDHRLIDGREAVFFLRRIKDVVEDPRRLLLDI

SEQ ID NO: 2901 - protein, 514 aa, Vitis vinifera
MASILEPSKASFFPAMTKIVGTLGPKSRSVEVISGCLKVGMSVARFDFSWGDPDYHQETLENLKAAVKSTKKLCAVMLDTVGAELQVVNKCEKSISLLADGFVVLTPYQDQEASSELLPINFNGLAKAVKKGDTIFVGQYLFTGSETTSVWLEVSEVKGDDVVCMIKNSATLAGSLFTLHVSQIHIDLPTLSDKDKEVISTWGVKNKIDFLSLSYTRHAEDVRHARDHLSKLGDLHQTQIFAKIENVEGLNHFDEILQEADGIILSRGNLGIDLPPEKVFLFQKAAVYKCNMAGKPAVITRVVDSMTDNLRPTRAEATDVANAVLDGSDAILLGAETLRGLYPVETISIVGKICAEAEKVFNQDLYFKKTVKYVGEPMTHLESIASSAVRAAIKVKASVIICFTSSGRAARLIAKYRPTMPVLSVVIPRLKTNQLKWSFSGAFEARQSLIVRGLFPMLADPRHPAESTSATNESVLKVALDHGKASGVIKSHDRVVVCQKVGDASVVKIIELED

SEQ ID NO: 2902 - protein, 505 aa, Vitis vinifera
MVISTTISDSSEHLHATFASRYVRDPLPKFKMPERSIPKEAAFQIISDELMLDGNPRLNLASFVTTWMEEECDKLIMASVNKNYVDMDEYPVTTELQNRCVNMIAHLFNAPVGENETAIGVGTVGSSEAIMLAGLAFKRKWQQKRKSEGKPYDKPNIVTGANVQVCWEKFARYFEVELKEVKLREGYYVMDPVKAVEMVDENTICVAAILGSTLTGEFEDVKLLNELLTKKNTETGWGTPIHVDAASGGFIAPFLHPDLEWDFRLPLVKSINVSGHKYGLVYAGVGWVVWRTKDDLPEELIFHINYLGSDQPTFTLNFSKGSSQIIAQYYQFIRLGFEGYKNIMTNCMDNANVLKQGLVETGRFEIVSKDIGVPLVAFSLKDTSNYTVFDISNNLRRYGWIIPAYTMPPDAEHIAVLRVVVREDFSRSLAERLLSDIEKVMREMDAVQSRATTRATHVIATVDETREGEGEGSEKLNKKTVMENREEIAMYWKRVVDRKKTSGVC

SEQ ID NO: 2903 - protein, 526 aa, Vitis vinifera
MRRFVSGVLSSYQKRSLSHRSLRFFSSTTSLSNSDSPSSSSSAAMPTPVTLETINPKVLECEYAVRGEIVTLAQRLQQELQEKPGSLPFDEILYCNIGNPQSLGQQPITFFREVIALCDHPPILDKSETQGLFSADAIERAWQILDQIPGRATGAYSHSQGIKGLRDTIAAGIEARDGFPSNPNDIFLTDGASPAVHMMMQLLIRTEKDGILCPIPQYPLYSASIVLHGGTLVPYYLDEATGWGLEISELQKQLEDAKSKGITVRALVVINPGNPTGQVLSEDNQRDIVEFCKKEGLVLLADEVYQENVYVPDKKFHSFKKISRSMGYGEEDISVVSFQSVSKGYYGECGKRGGYMEVTGFGADVREQIYKVASVNLCSNITGQILASLVMSPPKVGDESYESYFMEKDGILSSLARRAKTLEDALNSLEGVTCNKAEGAMYLFPRIHLPEKAIKAAEAAKTAPDAFYARRLLNATGIVVVPGSGFGQVPGTWHFRCTILPQEDKIPAVVSRLTEFHKGFMEEFRD

SEQ ID NO: 2904 - protein, 563 aa, Vitis vinifera
MNTSQFMDKQIMDLSAGSQSNDFINLMSPEDDHLTGVGGGGGVGSKKEEIVPSYDFLPIRPKGSSQFSNLDAVGGAGGPRAWSSTDSKTNTPGIRNYGSLDSNELSKISLEKDRNIDAAIVSEIDRTMKKHADNLLHVLEGLSARLTQLESRTRNLENSVDDLKVSVGNNHGSADGKMRQLENILREVQTGVQVLRDKQEIVEAHLQLAKLQVSKADQQSETQNTVTLDSAKQAASPPQQSHQPLPPPVTPQTLPALPPPNAPPPPPQLNMQSPPAQLPSQFPPNQIPSIPQREPYFQPPGQAQEAPNQQYQLPPTQQPQPPPAAPSHQQYQPASLPQYSQPPQLPQQHHSIAPINPPPQHQPPLGHHPEETSYVPPQTYPPSLRQPPSQPPSQPLSGAPPSQQFYGPPSHMYEVPSGRSSSGFSTGFVPPPSGPTEPYSYSGSPSQYGSNMPMKPQQFSSGVQGGGSGYPQLPTARVLPHALPTASGPVGGSGPGSGSSGSGNRVPIDDVVDKVTNMGFPRDVVRATVRKLTENGQSVDLNVVLDKLMNDGEVQPPRGWFGR

SEQ ID NO: 2905 - protein, 575 aa, Vitis vinifera
MADSDCKTHDSQALVDGNLLAAKSFAAAGITHMFGVVGIPVTSFANRAVSMGIRFLAFHNEQSAGYAASAYGYLTGKPGLLLTVSGPGCVHGLAGLSNAAVNAWPMVLISGSCDQADFGRGDFQELDQVAVVRPFSKFSAKATDISQIPNCVFKVLDQALSGRPGGCYLDLPTDVLHQTVSQSEAETLLAAAEKSRAKPQFPSVESSLIEKAVSLLRHAERPLIVFGKGAAFARAENSIKKLVESTGIPFLPTPMGKGLLPDAHELAATAARSLAIGKCDVALVVGARLNWLLHFGEPPKWSKDVKFILVDVCEEEIQLRKPCLGLAGDAKQVLDMISLEIKDDPFCLGKSHPWVEAISKKARDNVSRMEAQLAKDVVPFNFLTPMRIIRDAILGVGSPAPILVSEGANTMDVGRSVLIQTEPRTRLDAGTWGTMGVGLGYCIAAAVASPDRLVVAVEGDSGFGFSAMEVETLVRYQLPVVVIVFNNGGVYGGDRRNPEEVTGPYKDDPAPTSFVPGAAYHVLIEAFGGKGYLVGTPDELKSALAESFSSRKPAVINVTIDPYAGAESGRMQHKN

SEQ ID NO: 2906 - protein, 616 aa, Vitis vinifera
MDSDFGIPRELSDLQKHRCLYEPELPPCLQGTTVRVEFGDATTASDLSGARTISRSFPHTYGQPLAHFLRATAKVPDAQVITEHPPIRVGVVFCGRQSPGGHNVIWGLHNALKIHNPKNILLGFLGGSEGLFAQKTLEITDDILSTYKNQGGYDLLGRTKDQIRTTEQVNAALSTCKNLKLEGLVIIGGVTSNTDAAQLAETFAEAKCQTKVVGVPVSLNGDLKNQFVESNVGFDTICKVNSQLISNVCTDALSAEKYYYFIRLMGRKASHVALECTLQSHPNMVILGEEVAASKLTLFDLTKQICDAVQARAEQDKYHGVILLPEGLIESIPEVYALLQEIHGLLRQGVSAVNISSKLSPWASALFEFLPPFIKKQLLLYPESDDSAQLSQIETEKLLAHLVEAEMNKRLKEGTYKGKKFNAICHFFGYQARGSLPSKFDCDYAYVLGHICYHVLAAGLNGYMATVTNLKNPVNKWRCGAAPITAMMTVKRYSRGPGTSSIGKPAVHPYALDLKGKAYELLSQNATKFLLDDLYRNPGPLQFDGPGADAKAVTLCVEDQDYMGRIKKLQQYLDKVRTIVKPGCSQDVLKAALSAMASVTEILSVMTSPSSGQTPL

SEQ ID NO: 2907 - protein, 644 aa, Vitis vinifera
MASVVGSTTEKLSKLDINGESIFSVPNLHKNLSILSPDQIKLARMLVEAGQSHLFQSWAEPGVEDEEKRGFFEQVARLNASYPGGLTSYIKTARELLADSKAGKNPFDGFTPSVPTGEVLTYGDDNFVNFEELGIREARNAVFVLVAGGLGERLGYNGIKLALPSETTMGTCFLQNYIESILALQDASCRLVQGYNHILRMPQSTIPTKRVSASIAKTKLGGGCQNQIPLVIMTSDDTHARTIELLESNAYFGMEPSQVKLLKQEKVACLDDNDARLAVDPKSKYRIQTKPHGHGDVHSLLYSSGLLNIWYDAGLRWVLFFQDTNGLLFKAIPAALGVSSSKLYDVNSLAVPRKAKEAIGGITKLTHADGRTMVINVEYNQLDPLLRATGHPDGDVNCETGYSPFPGNINQLILKLGPYIKELTKTGGAIKEFVNPKYKDSSKTSFKSSTRLECMMQDYPKTLPPSARVGFTVMDAWLAYAPVKNNPEDAAKVPKGNPYHSATSGEMAIYRANSLILRKAGGVQIDDPVQEVFNGQEMEVWPRITWKPIWGLTFSEIKRKISGSCSISQRSTLVIKGCNIFLEDLSLDGTLVVNSVEDAEVKVGGVVQNKGWILEKVDYKDTTVPEEVRTRGFRIKKVEQLEKN

SEQ ID NO: 2908 - protein, 699 aa, Vitis vinifera
MAETETFAFQAEINQLLSLIINTFYSNKEIFLREIISNSSDALDKIRFESLTDKSKLDAQPELFIHIVPDKTNNSLTIIDSGIGMTKADLVNNLGTIARSGTKEFMEALAAGADVSMIGQFGVGFYSAYLVAEKVIVTTKHNDDEQYVWESQAGGSFTVTRDTSGESLGRGTKITLYLKEDQLEYLEERRLKDLIKKHSEFISYPISLWIEKTTEKEISDDEDEEDKKDEEGKVEEVDEEKEKEEKKKKKIKEVSHEWSLVNKQKPIWMRKPEEITKEEYAAFYKSLTNDWEEHLAVKHFSVEGQLEFKAILFVPKRAPFDLFDTRKKPNNIKLYVRRVFIMDNCEELIPEYLGFVKGIVDSEDLPLNISREMLQQNKILKVIRKNLVKKCLELFFEIAENKDDYNKFYEAFSKNLKLGIHEDSQNKGKLAELLRYHSTKSGDELTSLKDYVTRMKEGQNDIYYITGESKKAVENSPFLEKLKKKGIEVLFMVDAIDEYAVGQLKEFEGKKLVSATKEGLKLDESEDEKKKQEALKEKFEGLCKVIKDVLGDRVEKVVVSDRVVDSPCCLVTGEYGWTANMERIMKAQALRDSSMAGYMSSKKTMEINPENPIMEELRKRADADKNDKSVKDLVLLLFETALLTSGFSLDEPNTFGNRIHRMMKLGLSIDEDGPEADTDMPPLEEADADAEGSKMEEVD

SEQ ID NO: 2909 - protein, 752 aa, Vitis vinifera
MKKKTHLLHFVLLHSLLFLGCLALCSAEQISISSHGHLTDAEVMYIKRRQLLYYRDEFGDRGEDVTVDPSLVFENPRQRNAYIALQAWKQAILSDPLNLTLNWVGSNVCNYTGVYCAQAPDNSSIRTVAGIDLNHGDIAGYLPEELGLLTDLALFHINSNRFCGTVPHKFAKLKILFELDLSNNRFAGKFPEVVLHLPTLKFLDLRFNEFEGTVPKELFDKDLDAIFINHNRFAFDLPDNFGNSPVSVIVVANNKLHGCVPASLGNMADTLNEIILMNNQFRSCLPVEIGLLKNLTVLDVSYNGLLGPLPKEIGGMVELEQLNVAHNMLSGSIPASICKLPNLENFTFSYNFFTGEPPACLGLADFEDRRNCLPGRPEQRSAGQCNSFLSRPVDCSSFRCSPFVPSLPTPPPPSPPVFPSPPPTPVYSPPPVFSPPPPVLSSPPPPSPPPPSPSPPPPPVYSPPPPPPVYSPPPPPPPPPPPPPVYFPPPPPPSPPPPSPPPPSPPPPSPSPPPPPSPPPPVLSPPPPVYCVRSPPPPPPNSPPPPIYSPPPPPVHSPPPPSPYYSSPPPPPPHHSPPPPPHSPPPPPPIYPYASPPPPPVHSPPPPVHSPPPPCIEPPPPSPPPPSPPPCIEPPPPPSPPPCVEYSPPPPSPHSPPPPPVHYLPPPSPSPPPPPVYASPPPPPSLPPPVYYHSPPPPSPPPPTPCENPPPTPSPPPPIIYESPPPPTPVYEGPLPPIFGVSYASPPPPPFY

SEQ ID NO: 2910 - protein, 841 aa, Vitis vinifera
MATETLLSDHHSPDKTMEKVFEETQTVKLEDVDPPKEVGGKDEEEKLDADGLAGSETPVNKLEETTGMQTKLPTAVEVKKVDDAPVVDVHVEADSEKIENCALNPESLSASGMGDGAVETQSGDPEKCIVVEKVENPSLVDVPAEVDLKVVENSVLDPESDSASKPGETPEEHSVDVLKVDDGPIVDIPTETGSKVVENSVLEPEPSSASEPGGENFERQLEAPKGDTTEVEKVDVVSVADVLVEAGPKVVENSVLEPESSPSEPIAVAAERLSEEHPTVVEKVDDATIVDVPCEASLEVVENSVPEPESSPSEPIGVAAERLSEEHPTVVEKVDDATIVDVPCEASLEVVENSVLEPESSPSKPIGVAAERLSEEHPTVVEKVDDATIVDVPCEASLEVVENSVLEPESSPSEPIGVAAEKLSEEHPTVVEKVDDAAIVDVLCEASLEVVENSVLEPESSPSEPIGVAAERLSEEHPTVVEKVDDATIVDVPCEASLEVVENSVLDPESSSASKPGDEMVESQREALEEHPVEVEKVDNIPIVDFPAEAGAAARATDKEEGGGDVVERLSKDETVVAAKVEQQKEEKNVKIEDSEGKNTKVEESIQTETAKTDDRNGSNFVAEVAEIDREQVSRDVEEVAEVKKLENVEEDIPLSVEADKKNVKIEDCEGKNTKVEESIQTETAKTDDRNGSNFVAEVAEIDREQVSRDVEVVAEVKKLENVEEDIPLSVEADKDKDGEGKLSEVDAKETVKTNADNLESAKTDGEIAKSNPPNLETLKNGDDSKTSAKPPKQDDSVKKHSNNLISKVKQSIVKVKKAITGKSPSPKALLPEAKGDEKVK

SEQ ID NO: 2911 - protein, 1116 aa, Vitis vinifera
MDPESTQLQQAQLAAILGPDPGPFETLISHLMSTSNDQRSHAELLFNLCKQSDPNSLSLKLAHLLQFSPHIEARAMAAILLRKQLTRDDSYLWPRLSASTQSSLKSILLGCIQREDAKSISKKLCDTVSELASSILPENGWPELLPFMFQCVTSDSAKLQEAAFLIFAQLAQYIGETLVPHIKHLHSVFLQSLTSSSSSDVKIAALSAAINFIQCLSSSADRDRFQDLLPAMMRTLTEALNCGQEATAQEALELLIELAGTEPRFLRRQLVDVVGSMLQIAEAESLEEGTRHLAVEFVITLAEARERAPGMMRKLPQFISRLFAILMKMLLDIEDDPAWHSADSEDEDAGESSNYSVGQECLDRLAISLGGNTIVPVASELLPAYLAAPEWQKHHAALIALAQIAEGCSKVMIKNLEQVVTMVLNTFQDPHPRVRWAAINAIGQLSTDLGPDLQVQYHQRVLPALAASMDDFQNPRVQAHAASAVLNFSENCTPDILTPYLDGIVGKLLVLLQNGKQMVQEGALTALASVADSSQEHFQKYYDAVMPYLKAILMNATDKSNRMLRAKAMECISLVGMAVGKDKFRDDAKQVMEVLMSLQGSQMETDDPTTSYMLQAWARLCKCLGQDFLPYMSVVMPPLLQSAQLKPDVTITSADSDNEIEESDDESMETITLGDKRIGIKTSVLEEKATACNMLCCYADELKEGFFPWIDQVAPTLVPLLKFYFHEEVRKAAVSAMPELLRSAKLAVEKGLAQGRNESYVKQLSDYIIPALVEALHKEPDTEICASMLDALNECLQISGRILDESQVRSIVDEIKQVITASSSRKRERAERTKAEDFDAEEGELLKEENEQEEEVFDQVGEILGTLIKTFKASFLPFFDELASYLTPMWGKDKTAEERRIAICIFDDVAEQCREAALKYYDTYLPFLLEACNDDNSDVRQAAVYGLGVCAEFGGAAFKPLVGEALSRLNVVIRHPNALQPDNVMAYDNAVSALGKICQFHRDSIDSAQVVPAWLSCLPIKGDLIEAKVVHDQLCSMVEMSDRELLGPNNQYLPQIVAVFAEVLCAGKDLATEQTISRMINLLRQLQQTLPPSTLASTWSSLQPQQQLALQSILSS

SEQ ID NO: 2912 - protein, 151 aa, Vitis vinifera
MALTGKLETETEIKAPADKFFKIFRSQAHHLPNICSDKIHKIEVHEGDWETQGSVKHWSLTVGENSESIKETVDQIDEENRSITFKVLDGEVLKDYKSYKFTTQAIPKGEGCLVIWTIEYEKASEGGPDPHNCLEFSVNITKDIESHLLNA

SEQ ID NO: 2913 - protein, 160 aa, Vitis vinifera
MSDEEHHFESKADAGASKTYPQQAGAIRKNGYIVIKARPCKVVEVSTSKTGKHGHAKCHFVGIDIFNGKKLEDIVPSSHNCDVPHVTRTDYQLIDISEDGFVSLLTDSGGTKDDLRLPTDDNLLTQIKDGFAEGKDLVVTVMTAMGEEQICALKDIGPKN

SEQ ID NO: 2914 - protein, 180 aa, Vitis vinifera
MASSMVSSATVATINRATPAQANMVAPFTGLKSLSTFPGTRKANTDITSVASNGGRVRCMKVWPTEGLMKFETLSYLPPLNDEQLCKEVDYLLRMKWIPCLEFTKLYPYPHREHNRSPGYYDGRYWTMWKLPMFGCTDSAQVIKEVQEARTAYPDAHIRIIGFDNNRQVQCIAFIAYKPS

SEQ ID NO: 2915 - protein, 200 aa, Vitis vinifera
MKLVLWSLLLLGTLAISQAKKSTENLKEVTHKVYFDVEIDGKPAGRVVMGLFGKTVPKTVENFRALCTGEKGIGSSGKPLHFKGSAFHRIIPSFMIQGGDFTLGDGRGGESIYGEKFADENFKLKHTGPGLLSMANAGPDTNGSQFFITTVTTSWLDGRHVVFGKVLSGMDVVYKMEAEGRQSGTPKTKVVIADSGELPL

SEQ ID NO: 2916 - protein, 196 aa, Vitis vinifera; identical to SEQ ID NO: 495

SEQ ID NO: 2917 - protein, 222 aa, Vitis vinifera
MRFTTTLPILFPLLLSLLFTSTHAATFDILNKCTYTVWAAASPGGGRRLDSGQSWTITVNPGTTNARIWGRTSCTFDANGRGKCETGDCNGLLECQGYGSPPNTLAEFALNQPNNLDYIDISLVDGFNIPMDFSGCRGIQCSVDINGQCPSELKAPGGCNNPCTVFKTNEYCCTDGPGSCGPTTYSKFFKDRCPDAYSYPQDDKTSLFTCPSGTNYKVTFCP

SEQ ID NO: 2918 - protein, 236 aa, Vitis vinifera
MATPDESSSAKKWLPLEANPDVMNQFLWGLGLLEDEAECYDVYGLDEELLAIVPKPVLAVLFLYPITTQSEEERILQDSTKRETSNKVYFMRQTVGNACGTIGLLHAIGNVTSEIKLVEGSFLNRFFKSTASMDPLERAAYLENDQEMEVSHSVAATAGDTEASTNADAHFICFSCVDGELYELDGRKSGAVSHGPSSPSTLLQDAAKVIQGIIQKNPDSINFNVIAISKKLEGPY

SEQ ID NO: 2919 - protein, 245 aa, Vitis vinifera
MAVTFYGVNSGSGLKKLDEYLLTRSYISGYQASKDDITVHAALSKAPSSEYVNVSRWYNHIESLLRISGVSGEGCGVTIEGFAPVDAVATPPAEDTKATAAEDDDDDDVDLFGEETEEEKKAAEARAAAVKASGKKKESGKSSVLLDVKPWDDETDMKKLEEAVRSIKMEGLLWGASKLVPVGYGIKKLQIMLTIVDDLVSVDDLIEEQLTVEPTNEYVQSCDIVAFNKILLIHALIHLICVYRI

SEQ ID NO: 2920 - protein, 277 aa, Vitis vinifera
MAFFGKVGNILRQTVSKQVNSQFSVSNPSIYQAIRCMSSSKLFIGGLSYSTDDTSLREAFHKYGEVIEARVIVDRETGRSRGFGFVTFTSSEEASSAIQALDGQDLHGRRVRVNYATDRARSGGFGGGGGYGGGGGGYGGGGYGGGGYGGSGGYGGGGYGGGSGGYGGGGDSYGSGGGNYGSGGGGYGGSSGGYGSGGNFSVAGGSDNYVGGAAGSSSGFPSGGGSSFASGGADQLGTNESSSVGDGAGEFSPDEPATEGNYRDDDDEPDDYANRRA

SEQ ID NO: 2921 - protein, 271 aa, Vitis vinifera
MGSSLLLPLLCAGVVTVATLFLPSSFASEAYPSAYGSGSCNVELIPVKREVYADGRIFDITHPYTPNMPTFGTDEGIGEVIWLEKSMKNGSITNNSHMKMPTHTGTHVDSPGHVFDHYFDAGFDVETLDLEVLNGPALLVDAPRDKNITAEAMESLQIPKGVRRVLFRTLNTDRKLMFKKEFESDYAGFTEDGARWLVENTDIKLVGIDYVSVATYDHIVSAHLPFLEGREVILVESLKLDDVPAGMYNVHCLHLRLPGAEGAPIRCILIK

SEQ ID NO: 2922 - protein, 286 aa, Vitis vinifera
MAGRYEIELIISSAKDLKNVNWRHGSLKPYVVVWVDPAAKLSTKVDNDGDTFPCWNETLLIPVPSRIEDSTLYLDVVHLKADDEDDTKPVVGSARLFLRDVVDDVGFGAQAIRTLELRRPSGRPHGKVEVKVSVRDPRYRAPGSAYSPPYGVPPPAGTRGAGYAASPAYATPYGAPPPDPYYSNAPPYGQDPYRQPAYGQPQPRYGDPAYGQGPYAQGPYGQTVVEQPQKKSGMGMGTGLAVGAVAGVLGGLAISEGVDALEDHIADDVEDRIDGDDLEDYDGDDF

SEQ ID NO: 2923 - protein, 294 aa, Vitis vinifera
MVDEQRLPENNVQQIELLTGTEDSYGGVRIEIKNRMDSNVFGDVLRASISQWRQKGTKGVWIKLPIQHANLVEAAVKEGFWYHHAEPDYLMLVLWIPKTAHTLPANASHRVGIGAFVINSKREVLVVQENSGRFKGTGVWKLPTGVVNEGEDICTAAIREVEEETGIKTEFVEILAFRQSHKAFFTKSDLFFVCMLQPLSTEIQKQEEELEAAQWMAMEEYAAQPFVKKNPLFDSIANICLAKKDMKYTGFSPFSATSSSGKTNILYFNNQDLKQPLSSGKYKKTEPVQYKNNK

SEQ ID NO: 2924 - protein, 332 aa, Vitis vinifera
MAASLQAAATLMQPTKVGVPTRTSLQLRSSQSVCKAFGLEPAGARFTCSLQADLKDLAHKCVDATKIAGFALATSALLVSGASAEGAPKRLTYDEIQSKTYMEVKGTGTANQCPTIDGGVDSFAFKSGKYQLKKFCLEPTSFTVKAEGVSKNAPPEFQNTKLMTRLTYTLDEIEGPFEVSSDGTVKFEEKDGIDYAAVTVQLPGGERVPFLFTIKQLVASGKPDKFGGEFLVPSYRGSSFLDPKGRGGSTGYDNAVALPAGGRGDEEELKKENIKDASSSTGKITLSVTKSKPETGEVIGVFESIQPSDTDLGAKTPKEVKIQGFWYGQLES

SEQ ID NO: 2925 - protein, 327 aa, Vitis vinifera
MAETLVLRGTMRAHTDMVTAIATPIDNSDMIVTSSRDKSIILWHLTKDDKTYGVPRRRLTGHSHFVQDVVLSSDGQFALSGSWDGELRLWDLAAGTSARRFVGHTKDVLSVAFSVDNRQIVSASRDRTIKLWNTLGECKYTIQDADAHSDWVSCVRFSPNNLQPTIVSASWDRTVKVWNLTNCKLRATLAGHGGYVNTVAVSPDGSLCASGGKDGVILLWDLAEGKRLYSLDAGAIIHALCFSPNRYWLCAATEQSIKIWDLESKSIVEDLKVDLKTEAEKSEDTTTTAKKKGKIIYCTSLSWSADGSTLFSGYTDGVVRVWGIGRY

SEQ ID NO: 2926 - protein, 329 aa, Vitis vinifera
MSSESGSVTRSEVVCVTGGSGYIGSWLVCLLLRRGYTVHATVKNLKDERETKHLEALEGADSRLRLFQIDVLDYDSIVAAVNGAAGVFHLASPCIVDQVQDPEKELLDPAIKGTNNVLTAAKELGVGRVVVTSSISAIIPSPNWPADVVKGEDCWTDTEYCKQKGIWYPLSKTLAEKAAWEFAKEKGLDVVVVNPGTVMGPILPPGLNASMLMILRLLQGCTDIYEDFFMGSVHVKDVALAHILVYENKSASGRHLCVEAISHYGDFAAKVAELYPEYKVPRLPKDTQPGLLRAKTASKKLMDLGLQFIPMEQIIKDSVESLRSKGFIS

SEQ ID NO: 2927 - protein, 383 aa, Vitis vinifera
MAMMKRVAESAVRAFALGSTSGALTKHLHASAGSKKIVGVFYKANEYAAMNPNFVGCVEGALGIRDWLESQGHQYIVTDDKEGPDCELEKHIPDLHVLISTPFHPAYVTAERIKKAKNLQLLLTAGIGSDHIDLKAAAAAGLTVAEVTGSNVVSVAEDELMRILILVRNFLPGHHQVISGEWNVAGIAYRAYDLEGKTVGTVGAGRIGRLLLQRLKPFNCNLLYHDRIKMDPELENQIGAKFEEDVDVMLPKCDIIVINMPLTEKTKGMFNKERIAKLKKGVLIVNNARGAIMDTQAVADACSSGHIAGYSGDVWYPQPAPKDHPWRYMPNQAMTPHISGTTIDAQLRYAAGVKDMLDRYFKGEDFPAQHYIVKEGQLASQYQ

SEQ ID NO: 2928 - protein, 393 aa, Vitis vinifera
MAERHQHPNIMRKVAGQLHLSSSISQDVHTHYGSFQSPALYQRRSAFGNYSNVVLQYPMTQSCQATQDLSLIASTASPVFVQAPQEKGFASFAVDFLMGGVSAAVSKTAAAPIERVKLLIQNQDEMIKAGRLSEPYKGIGDCFSRTIKDEGFASLWRGNTANVIRYFPTQALNFAFKDYFKRLFNFKKDRDGYWKWFAGNLASGGAAGASSLLFVYSLDYARTRLANDAKAAKKGGGDRQFNGLVDVYRKTLKSDGIAGLYRGFNISCVGIIVYRGLYFGMYDSLKPVILTGKLQDSFFASFALGWVITNGAGLASYPIDTVRRRMMMTSGEAVKYKSSLDAFNQILKNEGAKSLFKGAGANILRAVAGAGVLAGYDKLQVLVLGKKYGSGGA

SEQ ID NO: 2929 - protein, 388 aa, Vitis vinifera
MWMKMESFRALLGGILVAWVLGVGGEVGMGLPSCGFPAIYNFGDSNSDTGGISAAFLPISAPYGENFFHKPAGRDSDGRVLIDFIAEHLGLPYLSAYLDSIGANYRHGANFATGGSTILRPNETIYQYGISPFFLDMQISQFDQFKARTRDLYIQAKSPSDRDKLPRPEDFPKALYTFDIGQNDLSVGFRQSYGQLRASIPDIVNKFTAAVQHLYQEGARTFWIHNTGPIGCLPVAVMYIRNPPPGMLDQYGCNKAQNEIAVEFNKQLKDGVMRLRAQLPQASITYVDLYAAKYGLISDAKGQGFVDPLKICCGNRVNDYNVWCGQKAIINGTEVYGSSCASPSAYISWDGVHYSQAANHWFANHILNGSLSDSSLPIAQACHKPYHF

SEQ ID NO: 2930 - protein, 389 aa, Vitis vinifera
MFVKSSVCFDFILMGSTGGTTYGEYTYENLEREPYWPSEKLRISITGAGGFIASHIARRLKTEGHYIIASDWKKNEHMPEDMFCHEFHLVDLRVMDNCLKVTTGVGHVFNLAADMGGMGFIQSNHSVIMYNNTMISFNMLEASRINGVKRFFYASSACIYPEFKQLETNVSLKESDAWPAEPQDAYGLEKLATEELCKHYTKDFGIECRIGRFHNIYGPFGTWKGGREKAPAAFCRKAITSTDKFEMWGDGLQTRSFTFIDECVEGVLRLTKSDFREPVNIGSDEMVSMNEMAEIVLSFENKNLPIHHIPGPEGVRGRNSDNNLIKEKLGWAPTMRLKDGLRITYFWIKEQIEKEKVQGIDLSVYGSSKVVGTQAPVQLGSLRAADGKE

SEQ ID NO: 2931 - protein, 423 aa, Vitis vinifera
MVRGLVNKLVSRSLNVAGKWQQQQLRRLNIHEYQGAELMSKYGINVPKGVAVGSIEEVRKTIQDVFPKENELVVKSQILAGGRGLGTFKSGLKGGVHIVKTDQVEELAGKMLGQILVTKQTGPQGKVVSKVYLCEKMSLVNEMYFAITLDRSSAGPIIIACRKGGTSIEDLAEKFPDMIVKVPIDVFQGITDEDAAKVVDGLAPKVADRNASIEQVKKLYKLFCECDCTLLEINPIAETSDNQLVAADAKLNFDDNAAFRQKHIFALRDATQEDPREVAAAKADLNYIGLDGEIGCMVNGAGLAMATMDIIKLHGGTPANFLDVGGNASESQVVEAFKILTADDKVKAILVNIFGGIMKCDIIASGIVNAAKEVSLKVPVVVRLEGTNVDQGKRILKESGMALITAEDLDDAAEKAVKASGTC

SEQ ID NO: 2932 - protein, 390 aa, Vitis vinifera
MSWWWAGAIGAAKKKFDEDDAPRGFQSVGLVIGVTGIVGNSLAEILPLSDTPGGPWKVYGVARRPRPDWNADHPVEYIQCDISDSEDALAKLSPLTDVTHVFYVTWTNRATEIENCEANGTMLRNVLRALIPNAPNLRHICLQTGGKHYIGPFEAFGKIKPHDPPYHEDLPRLDAPNFYYTLEDILFEECEKKDDLTWSVHRPVIIFGFSPYSMMNILGTLCIYAAICKHEGIPLKFPGSKAAWDCYSDASDADLIAEQQIWATVDPYARNEAFNITNGDLFKWKHLWKVLAEQFDMEYAEFEEGEEKQSMVEMMKDKGPVWEEIVREKELLPTKLEDVAQWWFIDLVLGGESLLNCMNKSKEHGFLGFRNSRNSFVWWIDKMRGHKLIP

SEQ ID NO: 2933 - protein, 410 aa, Vitis vinifera
MTTMTMKVAREEPAVSHTSRYALPTEPKDNGTRSNLCSGPLILLSHGDPTGFKPFWRSVGDKCKVTIDSCDFMSYLTDVGKVCWFLEKELEEAIRQLHRTVGNAATDDRYIVVGTGSTQLFQATLYALTSPGGPESVNVVSAVPYYSSYPEETNFLRSALYKWAGDAYTFDKEGPYLELVTMPNNPDGQVRGPVVNRNDGKLIHDLAYYWPQYTPITAQADYDIMLFTFSKSTGHGGSRIGWAVVKDEDVAIKMTKYIELNSIGVSRESQHRAAKILGAVSDSSQCIGANFFQYGKSLMAERWTKFREVISRSRLFSLPKYMEEYCQFSGEDTEPHPAFAWLKCNNDIEDLEIFLRRYKIMGRGGRLFGSDPKLVRVSMLGDEETFNLFLERLSSIQDTIGNGNGNGNYI

SEQ ID NO: 2934 - protein, 424 aa, Vitis vinifera
MGKKAVLIGCNYQGTKAELKGCINDVNRMYNSLVNRFGFSQDDITVLIDTDPDGVQPTGKNIRRALLNLIRSAQPGDILFVHYSGHGTRLPAETGEDDDTGYDECIVPTDMNLITDDDFRSFVDKVPEGCRITIVSDSCHSGGLIDEAKEQIGESTRLQQEQESGSGFGFKSFLHQTVQGAIESRGIQLPSALQHHRHHRRRHHEEDVDEGGVDAEYGDRGYVKSRSLPLSTLIEILKQKTGKDDIDVGKLRPTLFDVFGEDASPKVKKFMNVVMNKLQQGGEGGGEGGGFLGMVGSLAQDFLKQKLEENNEDYAKPALETEVGSKQEVYAGSGKRALPDNGILISGCQTDQTSADASPSGNSAEAYGALSNAIQTIIEESDGSIRNQELVLKARETLKRQGFTQRPGLYCSDHHADAPFICDI

SEQ ID NO: 2935 - protein, 432 aa, Vitis vinifera
MEEQQTMEVPFLSEAKSEIADKESKRLSSYQYVGRTGSVIPTASLAGTEVSVEEIRSAAAFSDYYPPSLHAALISSPEPDPDEQAIVCQGAYGGDYGGNTNEFQRQILDEVEIRELLIDHVGHRCCWGSRPARTWKIHAVEDCNVYVGTLETFIEEREIIKEREPYHGGKIDGKDKGPGLGIWELDLRSEFPVLFVPHKESCAKIPHSEAIEKCSGCAGRGDIVCSTCNPGQEPGFYNENRMSQCPTCHGRGLIAHRDGSDTKCVKCNGKGNISCPICGSRGLIKCELCRGGGSLLTHDVAVIRWKTLSTRKVSATSGAASVPDEVFHRAKGVQLCNTQAHQCTPAFFADSFSLNKFSSEVIADRSPVPPTARVVCERHSISVVPVTRVTMAHRRQSFSFYIIGFSREVYLKDYYPSRFCWGLCPCLDWLKL

SEQ ID NO: 2936 - protein, 451 aa, Vitis vinifera
MRECISIHIGQAGIQVGNACWELYCLEHGIQPDGQMPSDKTVGGGDDAFNTFFSETGAGKHVPRAVFVDLEPTVIDEVRTGAYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVTEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPTVVPGGDLAKVQRAVCMISNSTSVAEVFSRIDNKFDLMYSKRAFVHWYVGEGMEEGEFSEAREDLAALEKDYEEVGAESAEGDEGDEGDEY

SEQ ID NO: 2937 - protein, 464 aa, Vitis vinifera
  MOD_RES (295)..(328): Any amino acid
MASLPWSLTTSTAIANTTNISAFPPSPLFQRASHVPVARNRSCRFAPSKVSCNSANGDPNSDSTSDVRETSSGKLDRRNVLLGIGGLYGAAGGLGATKPLAFGAPIQAPDISKCGTATVPDGVTATNCCPPVTTKIIDFQLPSSDSPMRTRPAAHLVSKEYLAKYKKAIELQKALPDDDPRSFKQQANVHCTYCQGAYDQVGYTDLELQVHASWLFLPFHRYYLYFNERILAKLIDDPTFALPYWAWDNPDGMYMPTIYASSPSSIYDEKRNAKHLPPTVIDLDYDGTEPTIPDXXXXXXXXXXXXXXXXXXXXXXXXXXXXXXXXXXQQHRRLPKSSNSVIRVEVPRPKKSRSKKEKEDEEEVLLIKGIELDRENFVKFDVYINDEDYSVSRPKNSEFAGSFVNVPHKHMKEMKTKTNLRFAINELLEDLGAEDDESVIVTIVPRAGGDDVTIGGIEIEFVSD

SEQ ID NO: 2938 - protein, 464 aa, Vitis vinifera
MTKNVGILAMDIYFPPTCVQQEALEVHDGASKGKYTIGLGQDCMAFCSEVEDVISMSLTVVTSLLEKYGIDPKQIGRLEVGSETVIDKSKSIKTFLMQIFEECGNNDIEGVDSSNACYGGTAALFNCVNWVESSSWDGRYGLVVCTDSAVYAEGPARPTGGAAAIAMLVGPDAPIAFESKLRGSHMSHAYDFYKPNLASEYPVVDGKLSQTCYLMALDSCYKLLCSKYEKLEGKQFSIADADYFVFHSPYNKLVQKSFARLVFNDVVRNASSVDEAGKQKLEPFSSLSGDESYQNRDLEKASQQVAKPLYDAKVQPSTLLPKQVGNMYTASLYAAFVSVLHNKHSELSGKRVVMFSYGSGLTATMFSFQLRDGQHPFSLSNIATVMDVAGKLKARHEFPPEKFVEILKLMEHRYGAKDFVTSKDCSLLPPGTHYLTEVDSMYRRFYSKKAGSCTCENGSLANGH

SEQ ID NO: 2939 - protein, 475 aa, Vitis vinifera
MSPQTETKASVGFKAGVKDYKLTYYTPEYETKPTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIRAASKWSPELAAACEVWKEIKFEFPAMDTL

SEQ ID NO: 2940 - protein, 488 aa, Vitis vinifera
MESSNNASTTKVITGDAGYVLEDVPHLNDYIQGLPTYPNQLQTNPAYSVVKQYFVNVDDSVAQKIVCHKNSPRGTHFRRAGPRQKVYFESDEVHACIVTCGGLCPGLNTVIREIVCGLSHMYGVTRILGIDGGYKGFYSRNTIPLTPKVVNDIHKRGGTVLGTSRGGHDTSKIVDSIQDRGINQVYIIGGDGTQKGASVIFEEIRRRGLKVAVAGIPKTIDNDIPVIDKSFGFDTAVEEAQRAINAAHVESESIENGIGMVKLMGRYSGFIAMYATLASRDVDCCLIPESPFYLEGKGGLFEFIERRLKENGHMVIVMAEGAGQELLSESLLSMGQDASGNNLLQDVGLWMSHRIKDHFARQRKIAINLKYIDPTYMIRAIPGNASDNVYCTLLAQSAVHGAMAGYTGFTIGIVNGRHAYIPFHRINESRNKVVITDRMWARLLSSTNQPSFQNPKDVAEVKKEEAPATGLLDGDNSKDDHKPVDQKA

SEQ ID NO: 2941 - protein, 521 aa, Vitis vinifera
MTFDITLHGVLLWASTGFLMPIGVITIRMCNREECGRKVRVIFYVHTTLQVLSVLIATAGAIMSIKNFENSFNNYHQRIGLALYGAIWVQALIGFCRPGRRSKGRSVWYFVHWILGTTVSVVGMINIYTGLEAYQKKTSRSIRLWTVLFTAEVCLMAFFYLFQDKWEYMQKQGVIMGNEAVTPSDQVNGLELRILEEKTRLKDYEGLVSMQEEAGLVKETSDATKKSDSHDDDHDCDGNDSHGEDYEPGNDHHHESSDDHKHHHHGHPDMKAESWVGPDGKLYHSHDGLAPHTHEPIYSPGYFSRRAPPLLTRNFHERAFTVGIGGPVGTGKTALMLALCQCLREKYSLAAVTNDIFTKEDGEFLVKHGALPEERIRAVETGGCPHAAIREDISINLGPLEELSNLFKVDILLCESGGDNLAANFSRELADYIIYIIDVSGGDKIPRKGGPGITQADLLVINKTDLAPAVGADLAVMERDSLRMRDGGPFIFAQVRHGVGIEDIVDHVLHAWEVATGEKRH

SEQ ID NO: 2942 - protein, 608 aa, Vitis vinifera
MATGQLFSRTTQALFYNYKQLPIQRMLDFDFLCGRETPSVAGIINPGSEGFQKLFFGQEEIAIPVHSSIEAASAAHPTADVFINFASFRSAAASSMAALKQPTIRVVAIIAEGVPEADTKQLIAYARSNNKVVIGPATVGGIQAGAFKIGDTAGTIDNIIQSKLYRPGSVGFVSKSGGMSNELYNTIARVTDGIYEGIAIGGDVFPGSTLSDHVLRFNNIPQVKMVVVLGELGGRDEYSLVEALKQGKINKPVVAWVSGTCARLFKSEVQFGHAGAKSGGEMESAQAKNQALSEAGAVVPTSYEAFETAIKETFEKLHEEGKITPVKEVAPPQIPEDLNTAIKSGKVRAPTHIISTISDDRGEEPCYAGVPMSSIVEQGYGVGDVISLLWFKRSLPRYCTHFIEICIMLCADHGPCVSGAHNTIVTARAGKDLVSSLVSGLLTIGPRFGGAIDDAARYFKDAYDRGLTAYEFVEDMKKKGIRVPGIGHRIKRGDNRDKRVELLQRFARTHFPSVKYMEYAVEVETYTLSKSNNLVLNVDGAIGSLFLDLLAGSGMFTKQEIDEIVQIGYLNGLFVLARSIGLIGHTFDQKRLKQPLYRHPWEDVLYTK

SEQ ID NO: 2943 - protein, 623 aa, Vitis vinifera
MPSVYGARMTTFEDSEKESEYGYVRKVSGPVVVADGMAGAAMYELVRVGHDNLIGEIIRLEGDSATIQVYEETAGLTVNDPVLRTHKPLSVELGPGILGNIFDGIQRPLKTIAKISGDVYIPRGVSVPALDKDILWEFQPKKLGEGDLLTGGDLYATVFENSLMQHHVALPPDAMGKITYVAPAGQYSLKDTVLELEFQGVKKQITMLQTWPVRTPRPVASKLAADTPLLTGQRVLDALFPSVLGGTCAIPGAFGCGKTVISQALSKYSNSDTVVYVGCGERGNEMAEVLMDFPQLTMTLPDGREESVMKRTTLVANTSNMPVAAREASIYTGITIAEYFRDMGYNVSMMADSTSRWAEALREISGRLAEMPADSGYPAYLAARLASFYERAGKVKCLGGPERNGSVTIVGAVSPPGGDFSDPVTSATLSIVQVFWGLDKKLAQRKHFPSVNWLISYSKYATALESFYEQYDPDFINIRTKAREVLQREDDLNEIVQLVGKDALAETDKITLETAKLLREDYLAQNAFTPYDKFCPFYKSVWMMRNIIHFYNLANQAVERGAGMDGQKITYTLIKHRLGDLFYRLVSQKFEDPAEGEEVLVAKFSKLHEDLTAGFRNLDDETR

SEQ ID NO: 2944 - protein, 687 aa, Vitis vinifera
MEDSLRKALSEKQAAVDAQGGAVRELKASGAPKDAIDAAVQELNALKLEKASIEKQLQAALTNGNDNALSRDAFRQALVNTLERRLFYIPSFKIYRGVAGLYDYGPPGCAVKSNVLAFWRQHFVLEENMLEVDCPCVTPEIVLKASGHVDKFTDLMVKDEKTGTCYRADHLLKDFCKEKLEKDLTISGEKAAELKHILAVLDDLSAEELGGKIKEYGITAPDTKNPLSAPYPFNLMFQTSIGPSGLSPGYMRPETAQGIFVNFKDLYYYNGNKLPFAAAQIGQAFRNEISPRQGLLRVREFTLAEIEHFVDPDDKSHPKFSEVANLEFLMFPRGEQVSGQSAKRTVLGEAVSKGIVNNETLGYFIGRVYLFLTGLGIDKERLRFRQHLANEMAHYAADCWDAEIECSYGWIECVGIADRSAYDLRAHTDKSGVPLVAHEKFAEPREVEKLIIAPVKKELGLAFKGNQKMVVEALEAMSEKEAMEMKATLESTGEVGFHVCTLGKDVTITKKMLSISKEKKKEHQRVFTPSVIEPSFGIGRIIYCLYEHSFYTRPSKAGDEQLNVFRFPPLVAPIKCTVFPLVQNQQYEEVAKSIAKSLTAAGISYKIDITGTSIGKRYARTDELGVPLAITVDSTSSVTIRERDSKDQIRVSVEEVASVVKEVTDGQSTWADVLWRYPTHSSASVDE

SEQ ID NO: 2945 - protein, 1099 aa, Vitis vinifera
MAGAVDLSFSSSANLEIFKLDFQSDDQDLSLVGESPSSERFNRLSWGKNGSGSEEFALGLIAGGLVDGNIDVWNPLKLIRSEASESALVGHLSRHKGPVRGLEFNAIAPNLLASGADEGEICIWDLAAPAEPSHFPPLKGSGSANQGEISFLSWNSKVQHILASTSYNGTTVVWDLKKQKPVISFSDSNRRRCSVLQWNPDVATQLVVASDEDNSPALRLWDMRNTITPVKEFVGHTKGVIAMSWCPIDSSYLLTCAKDNRTICWDTISGEIVCELPAGTNWNFDIHWYPKIPGVISASSFDGKIGIYNIEGCSRFGIGENEFGAAPLKAPKWYKRPAGVSFGFGGKLVSFHTKSSAAGASTGGSEVHVHDLVTEQSLVTRSSEFEAAVQHGERSSLKALCDRKSQESESSDDRETWGFLKVMFEDDGTARSKLLTHLGFDMVNEEKDTVQNDLSQEVNALGLEESTAEKVAYVEEKETTIFPSDNGEDFFNNLPSPKADTPLSTSVNNFVVEETATVEQMQQEVDGQEESADPAFDECVQRALVVGDYKGAVAQCMAVNKMADALVIAHVGGSSLWESTRDQYLKMSRSPYLKVVSAMVNNDLMSLVNTRPLKSWKETLALLCTFAPREEWTMLCDTLASKLMAFGNTLAATLCYICAGNIDKTVEIWSRSLTAEHEGKSYVDVLQDLMEKTIVLALATGQKRFSASLYKLVEKYSEILASQGLLKTAMEYLKLLGSDELSPELVILRDRIALSTEPEKEVPKTMPFDNSQGLAYGADQSSYGVVDSSQHYYQETAPTQMQSSVPGSPYGDNYQQPFGTSYGSRGYVPPAPYQPAPQPHMFLPSQAPQVPQENFAQPPVTSQPAVRPFVPATPPVLRNVEQYQQPTLGSQLYPGATNSTYQSGPPGAGSLGSVTSHVGTVPGHKLPQVVAPTPTQRGFMPVNSGVVQRPGMGPMQPPSPTQQAPVQPAITPAAPPPTIQTVDTSNVPAQQRPVVATLTRLFNETSEALGGSRANPAKKREIEDNSRKIGALLAKLNSGDISKNAADKLVQLCQALDNGDFGTALQIQVLLTTSEWDECNFWLATLKRMIKTRQNVRLS

SEQ ID NO: 2946 - protein, 1121 aa, Vitis vinifera
MEEEAQGSTEVAVLKVVENIAVDTADPIKVTNGDLHQEETALDGEFIKVEKELIDNWHQRIVEVEEKHGIELKNLQDALEAHEVKHKELIGVKEAFDNLSLELESSMKKMGELESELQVSAGDARNNAARMQELCDDLETKLKQSDENFCKTDSLLSQALANNAELEEKLKSQEALHQETGTIASTATQKSIELEGLVQASNVAAEEAKAQLRELETRLIGAEQRNVELEQQLNLVELQSSEAERELKEFSEKMSELSVALREVEEEKKELKGQMQEYEDKITQLESALSQSSLEKSELGLELKSVAAKCTEHEDRANSTHQRSLELEDLMQLSHSKKYLEQISDIEAELQISRAESKSLEKALELASETERDITERLNISIEVKKGLEEALSSSSEKLAEKENLLQVLQNELSLTQEKLQSIETDLKAAGVKESEIMEKLKSAEEQLEQQGRIIEQSTARSLELEELHETLKRDSEFKLNEAIASLSSRDSEAQSLYEKLKSHEDQVKTYELQVADTAEKSTSLKEELERCLGELAALQSTNEELKVKISEAESKAAESVSENELLVETNIELKSKVDELQEQLNSASAEKEATAHQLVSHRNTIVELTDQHSRSCELQSATEERVKEAEIQLEEAVQRFTHRDSEAKELNEKLTALESQIKVYEEQAHEASAISETRKVDLEQTLLKLKDLESVVEELQTKLGHFEKESEGLAEANLKLTQELAAYESKMNDLQEKLLTAFSEKDETVEQLQFSKKGIEDLRQQLATEGQKLQSQVSSVMEENNLLNETYQAAKNELQAVIIQLEGQLKEQKANEDAIKAEMENLKAEIADKSVLQTRLDELEKQLVLAEARLKEEVETVQAAAAGREAELNIQLEDHVRKVHDRDILSGQVVQLQEELHLAHTSIAEKTVLQTRLEELEKQLVIAEAQLKEEVESVRAAAVGREAELSTQLEEHARKVQDRDSLSEQVVQLQKELHLAQTSIVEQKETHSQKELEREAAAKHLLEELEAKKQELILKENQVKELEQKLQLAEAKSKEKADGGSPSEGMEVKSRDIGLVTSTPSRRKSKKKSEGTSPQTSSSSEIHARANEVSSAMTLKFILGVALVSVIVGIILGKRY

SEQ ID NO: 2947 - protein, 99 aa, Vitis vinifera
MESNLSPKFAQKVFEGEGGSYYSWSSTEFELLKEAKVGGGRLVLQPRGFGPPHYADCNKIGYVLQGTCGIVGMVFPKASEEVVLKLKKGDTIPVPSGVV

SEQ ID NO: 2948 - protein, 131 aa, Vitis vinifera
MSWQTYVDDHLMCEIEGNHLTAAAILGQDGSVWAQSATFPQFKPEEITAIMTDFAEPGTLAPTGLYLGGTKYMVIQGEPGAVIRGKKGSGGACIKKTIQALIIGIYDEPLTPGQCNMIVERLGDYLIDQGL

SEQ ID NO: 2949 - protein, 162 aa, Vitis vinifera
MAPIAVGDVIPDGTLAYFDEQDQLQQASVHSLAAGKKVIIFGVPGAFTPTCSVKHVPGFIEKAGELKSKGIDEILLVSVNDPFVMKAWAKTYPDNKDVKFLADGSATYTHALGLELDLSEKGLGTRSRRFALLVDDLKVKVANVEAGGEFTVSSADDILKAI

SEQ ID NO: 2950 - protein, 159 aa, Vitis vinifera
MGSEGSGVVVPRNFRLLEELERGEKGIGDGTVSYGMDDADDIYMQSWTGTIIGPPNTVHEGRIYQLKLFCGQDYPDNPPTVKFQTRINMTCVNQETGVVEPSLFPMLATWQREHTMEDILTQLKKEMMSPQNRKLAQPPEGNEEARIDQKGLVLKCCIL

SEQ ID NO: 2951 - protein, 174 aa, Vitis vinifera
MSVGMQDVLDFDLSAYDTLFAINVRGVAASVKHAARAMVEGKVKGSIICTASVSASTGSDKFIDYVMSKMAVLGLVKSASRQLGAYGIRVNSVSPGAVATPLLCDKFQMSATEVENNFEQYMSLKGLNMEKHLFLLFPKETFKTLKIAKNIKNALDNDSTPNIFSRSTFRRITY

SEQ ID NO: 2952 - protein, 205 aa, Vitis vinifera
MECVFGLVGDGFALVVADSSAVHSILVHKSNEDKIMVLDSHKLLGASGEGGDRAQFTEYIQKNVALYQFRNGIPLTTAAAANFTRGELATALRKNPYAVNILLAGYDKDIGPSLYYIDYIASLHKIEKGAFGYGSYFSLAMMDRHYHSGMTVEEAVDLVDKCIMEIRSRLVVAPPNFVIKIVDKDGAREYAWRESIKDTTGAPTS

SEQ ID NO: 2953 - protein, 215 aa, Vitis vinifera
MANHDGEISSKTSGFPHHVVLNERILSSMSRRSIAAHPWHDLEIGPGAPSVFNCVVEIGKGSKVKYELDKASGLIKVDRVLYSSVVYPHNYGFIPRTICEDSDPMDVLILMQEPVLPGSFLRARAIGLMPMIDQGEKDDKIIAVCADDPEFRHYKDIKEIPPHRLAEIRRFFEDYKKNENKEVNVNDFLPADSAIEAIKYSMDLYASYIVESLRQ

SEQ ID NO: 2954 - protein, 206 aa, Vitis vinifera; identical to SEQ ID NO: 492

SEQ ID NO: 2955 - protein, 234 aa, Vitis vinifera
MSPVPSVTAVQVENVLFPPSVKPPGSTNDLFLGGAGVRGLEIQGKFVKFTAIGVYLESSAVPTLAVKWKGKTVEELADSVDFFRDVVTGPFEKFTKVTTILPLTGRQYSDKVSENCVAFWKSVGIYTDAEAKAIEKFNEVLKDETFPPGNSILFTHSPLGALTMSFSKDGSLPEVGNAVIENKLLTEAVLESIIGKHGVSPEAKKSLAARLSELFCKEAGDEKIEAEKVAPVAC

SEQ ID NO: 2956 - protein, 223 aa, Vitis vinifera
MTKQQANWSPYDNNGGSCVAIAGADYCVIAADTRMSTGYNILTRDYSKICKLADKCVMASSGFQADVRALQKHLAARHLIYQHQHNKQMSCPAMAQLLSNTLYYKRFFPYYSFNVLGGLDNEGKGCVFTYDAVGSYEKVGYSSQGSGSTLIMPFLDNQLKSPSPLLLPALDAVTPLSEPEAVDLVKTVFASATERDIYTGDKLEIVILNASGIRREYMDLRKD

SEQ ID NO: 2957 - protein, 239 aa, Vitis vinifera
MSGPQCCEHPPSLNPNSGSGHVEQLGGLSCYIAGSPHSKLAILLVSDIYGYEAPNFRKLADKVAAAGFYVVAPDFLYGDTYVPDKAERPFPVWIKDHGMDKGFEDTKPVIEALKSKGVSAIGAAGFCWGAKVVVELAKSGYIQAAVLLHPSFVSLDDIKGVKVPTAVLGAEIDQMSPPALVKQFEEILTAKPGVDGFVKIFPGVAHGWTVRYNAEDAGAVKCAEEAHQDMLGWFSKYVK

SEQ ID NO: 2958 - protein, 239 aa, Vitis vinifera
MSGPQCCENPPTLTSSSGAGCVAEIGGLKAYVSGPSDSKLVILLVSDLFGYEAPNLRKLADKVAAAGFYVVVPDFFYGDPFVPETMTIPVWIKKHMEWFDKGFEDAKPVVAELRSKGINAIGAAGFCWGAKVVVELSKVDQIQAAVLFHPARVTVDDIKEIKAPTAILGAETDHVSPPELLKQFEEVLSTKPEVNGYVKIFPGVAHGWSVRYKVEDEEAVKRADESHQNMMDWFAQYVK

SEQ ID NO: 2959 - protein, 223 aa, Vitis vinifera
MADEIILLDFWASHFGMRVRIALAEKGLMYEYREENLWNKSPLLLEMNPVHKKVPVLIHNGKPICESLMIVQYIDEVWKDKSPLLPSDPYQRAQARFWADYVDKKVPQLYHELGKKIWYTKGEEHEAGKKEFIECLKFFEGELGEKPYFGGENFGFEDVALVPLSCWFYTYESFGNFSVEDECPNLMAWAKRCGQKESVSSSLADPHKVHGFVMEMRKRLGID

SEQ ID NO: 2960 - protein, 249 aa, Vitis vinifera
MKFNIANPTTGCQKKLEIDDDQKLRAFFDKRISQEVSGDALGEEFKGYVFKIMGGCDKQGFPMKQGVLTPGRVQLLLHRGTPCFRGYGRRNGERRRKAVRGCIVSQDLSVLNLVIVKKGEGELPGLTDVEKPRMRGPKRASKIRKLFNLSKEDDVRKYVNTYRRTFTTKSGKKCSKAPKIQRLVTPLTLQRKRARIAEKKKRIAKAKSEAAEYQKLLATRLKEQRERRSESLAKKRSRLSAASKPSIVA

SEQ ID NO: 2961 - protein, 253 aa, Vitis vinifera
MTVSSGENSADSKYSLSGLAPLEAVLFDIDGTLCDSDPLHYYAFRELLLQIDYNGGVPITEEFFIEKIAGKHNDDIARGLFPNWDLEKGLKFTDDKEVLFRKLAKDQVKPLNGLHKIRKWIEDRGLKRAAVSNAPRPNAELMISLLGLSDFFHAVVVGSECDRAKPFPDPYLKALEVLQVSKDHTFIFEDSVSGIKAGVAAEMPVVGLTTRNPESLLMEAKPVFLIRDYDDPKLWAALAELDQKGAPGATAAA

SEQ ID NO: 2962 - protein, 255 aa, Vitis vinifera; identical to SEQ ID NO: 565

SEQ ID NO: 2963 - protein, 256 aa, Vitis vinifera; identical to SEQ ID NO: 852

SEQ ID NO: 2964 - protein, 255 aa, Vitis vinifera
MLAIFHKAFAHPPEELNSPASRDGSRKPKLPEETLREFLSAHPANTFSMSFGTAAALAYVSPDRSYPTHQRLFGGFDDIYCLFMGSLNNLCTLNRQYGLSKGSNEAMLVIEAYRTLRDRGPYPADQVVKDLEGSFAFVVYDSKAGTVFTALGSDGGVKLFWGVAADGSVVISDDLGVIKAGCAKSFAPFPTGCMFHSDGGLMSFEHPMNKMKAMPRIDSEGVMCGANFKVDVYSRINSMPRVGSEVNWSNWEDYH

SEQ ID NO: 2965 - protein, 258 aa, Vitis vinifera
MKIVPVPCLEDNYSYLIIDESSKEAAVVDPVEPQKVLQAAYEYGVHLKLVLTTHHHWDHAGGNEKIKQLVPGIEVYGGSVDNVKGCTHPLQNGDKLSLGSDLAVLALHTPCHTRGHISYYVTGKEEDVPAVFTGDTLFVAGCGKFFEGTAEQMYQSLCVTLASLPKPTRVYCGHEYTVKNLQFALTVEPDNVRVGQKLSWAQHQRQAGLPTIPSTIDEEMETNPFMRVDLPELQERVGCQSAIDALQEIRRQKDNWRG

SEQ ID NO: 2966 - protein, 269 aa, Vitis vinifera
MADENQNEVKDEVAELAPFDPTKKKKKKKVVIQDPADDSVDKLAEKTESLSVSEGVENTFSGMKKKKKKPVETDILNDDGGDGKEDLDDHNGEDEEGEGIVLQPRYPWEGSDRDYKYEELLGRVFNILRENNPELAGDRRRTVMRPPQVLREGTKKTVFVNFMDLCKTMHRQPDHVMAFLLAELGTSGSLDGQQRLVVKGRFAPKNFEGILRRYINEYVICLGCKSPDTILSKENRLFFLRCEQCGSGRSVAPIKAGFVARVGRRNTGT

SEQ ID NO: 2967 - protein, 289 aa, Vitis vinifera
MADHITKGEEFEKKAEKKLSGWGLFGSKYEDAAELYEKAANSFKLAKSWDKAGSINIKLANCHLKLDSKHEAANAYADAANCYKKTSNKEAIACLEQAAAIFLEIGRLNMAARYYKEIGELYEVDQNLQQAIEKFDQAAELFQSEEVTTSANQCRQKVAQFSAQLEQYPKAIEIYEEIARQSLNNNLLKYGVRGHLLNAGLCQLCKGDVVAITNSLERYQELDPTFSRTREYKLLADLAVAVDEEDVAKFTDVVKEFDSMTPLDAWKTTLLLRVKESLKAKELEEDDLT

SEQ ID NO: 2968 - protein, 291 aa, Vitis vinifera
MEAKPTEISGSKMFGGYNKRFKHFSPTLGCSMTFHVYFPPLPSPSHKFPVLYWLSGLSCTDENFIIKSGAQRVASSEGIALVAPDTSPRGLNVEGEADSWDFGVGAGFYLNATQEKWKNWQMYDYVVKELPKVLSENFAQLDTSRASISGHSMGGHGALTIYLKNLDKYKSVSAFAPIVNPMNCPWGQKAFTNYLGGNKADWEEYDATCLISKFNDVSATILIDQGEDDKFLHDQLLPHKFEEACKNAKVPLLLRLQPGYDHSYYFIATFIDHHIQHHAQALNMCFKPLHP

SEQ ID NO: 2969 - protein, 300 aa, Vitis vinifera
MESDSEVSHEFRFFRVYKDGRVHLFMPPAEKFPPSDDPTTGVRSKDVHISPDTGVSARIFLPKTPSPTQKLPLLFYVHGGGFSMLSAFARPYIDCLNSIVSEANIIAVSVEYGLFPDRPIPACYEDSWAALQWVASHASGDGPEPWLNDYADFNRVFIAGDSAGGNISHTLAVRVGSIGLTGVRVVGVVLVHPYFGGTDDDKMWLYMCPTNGGLEDPRMKPAAEDLARLGCEKVLVFVAEKDHLREVGWNYYEELKKSGWKGTVEIVENHGEEHCFHLHDLSYEKSVDLIKQIASFINRE

SEQ ID NO: 2970 - protein, 302 aa, Vitis vinifera
MGSTRPQCSPGSGYIFIGELGFIVADAVSTQVHSRGVAAARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSIRDEEAKFKLCKVRSVQFGQKGIPYLNTYDGRTIRYPDPLIKANDTIKLDLESNKITDFIKFDVGNVVMVTGGRNRGRVGVIKNREKRKGSFETIHVQDATGHEFATRLGNVFIIGKGTKPWVTLPKGKGIKLSIIEEAQKRLAAQAASSA

SEQ ID NO: 2971 - protein, 293 aa, Vitis vinifera
MTLSSRLYTFASPKLPKHCARPQISPSFPLKYPPILTRSLPFASHFRRASLSFSTRSTAMGDAVDAGMDAVQRRLMFEDECILVDENDRIVGHDTKYNCHLMEKIESENLLHRAFSVFLFNSKFELLLQQRSATKVTFPLVWTNTCCSHPLYRESELIDENALGVRNAAQRKLLDELGIPAEDAPVDQFTPLGRMLYKAPSDGKWGEHELDYLLFIVRDVNVNPNPDEVADVKYVSRNDLKELLRKADAGEEGLKLSPWFRLVVDNFLFKWWDHVEKGTLLEAADMKTIHKLT

SEQ ID NO: 2972 - protein, 313 aa, Vitis vinifera
MEHLHSLHEKAKLEKSNGQLSHLFFPFFKIYQDGRVERFMHTDHVPPSDDPLTGVRSKDVIISPETGVSARLFIPKLPNPNCKLPLLIYIHGGGFSIQSAFSTSYNHYVKSLVAEANVIALSVDYRLAPEHPIPACYDDSWAAVQWAASHANGDGPDTWLNNHADFSRVFFAGDSAGGNISNTLAFRVGSSGLPGVKVVGVVLVHPYFGGTGDDQMWLYMCPNHGGLEDPRLKPGAEDLARLGCERVLMFVAEKDHLRPVAWDYYEKLKKSEWKGTVEIVENHGEEHVFHLMNPKCENAAVLMKKIVSFLNQE

SEQ ID NO: 2973 - protein, 332 aa, Vitis vinifera
MGNPLLDISSVVDEEFLQKYDIKLNNAILAEDKHLPMYDEMASKYNVEYIAGGATQNSIRVCQWMLQIPGATSYMGCIGKDKFGEEMKKNSKLAGVNVHYREDETAPTGTCAVCVVGGERSLIANLSAANCYKSEHLKRPENWALVEKAKYFYIAGFFLTVSPESILLVAEHAAANNKVFMMNLSAPFICEFFKDQQEKALPYMDYVFGNETEARTFAKVHGWETDNVEEIAIKISQWPKASGTHKRITVITQGADPVVVAEDGKVKSFPVILLPKEKLVDTNGAGDAFVGGFLSQLVQEKPIEECVRAGCYASHVIIQRSGCTYPEKPDFS

SEQ ID NO: 2974 - protein, 342 aa, Vitis vinifera
MDTLLQSNGHQASPWIYHKAFTKPNISPVESSHHHNSILTLSNISTPATPYTTAMATTTAAAAAATSSFMGTRLPDVHSNTGRVQARFGFGRKKAPAKKAAKRVSDRPLWFPGAVAPEWLDGTLVGDYGFDPFGLGKPAEYLQYDYDSLDQNLAKNIAGDVIGTRFEGGEVKSTPFQPYTEVFGLQRFRECELIHGRWAMLATLGALAVESLTGVTWQDAGKVELIEGSSYLGQPLPFSMTTLIWIEVLVIGYIEFQRNAELDPEKRLYPGGKFFDPLGLAADPEKKAVLQLAEIKHARLAMIGFLGFAVQAAVTGKGPLNNWATHLSDPLHTTIIDNVFYS

SEQ ID NO: 2975 - protein, 356 aa, Vitis vinifera
MEIDLTPKSAKEAYGSNGGSYLAWSPSELPMLGEGNIGAAKIILHQHGFALPSYSDSSKVAYVLQGNGVAGIVLPESEEKVVPIKKGDALALPFGVVTWWYNKEDTDLEVLFLGDTSKAHKAGEFTDFFLTGSNGIFTGFSTEFVSRAWDLEEDVVKSLVGKQSGKGIVKLEGTFEMPEPKKEHRNGLVLNCLEAPLDVDIKNGGRVVVLNTQNLPLVGEVGLGADLVRLDGSAMCSPGFSCDSALQVTYIVRGSGRVQVVGVDGHRVLETTLKAGSLFIVPRFFVVSKIGDPEGMDWFSIITTPNPIFTHLAGRTSAWKALSSKVLEASFSVGSDMEKLFRSKRNADAIFFPPPN

SEQ ID NO: 2976 - protein, 338 aa, Vitis vinifera
MAHSRVSAFSTAPGLKRVGTHNGSFHCDEALGCFMIRLTDKFRDAQIVRTRDQKVLDGLDAVLDVGGVYDPSRDRYDHHQKGFGEVFGHGFSTKLSSAGLVYKHFGMEIIAKELQLDQGHPDVLRLFLAVYKSFMEAVDAVDNGINQYDTDQPLRYVNNTHLSSRVGKLNLDWMDPDQSSEKENEAFERAMNLSGSEFLDNVRFHAKSWLPARSIVMECLAARMDIDPSGEIMVLNRFCPWKLHLFELEEEMKIDPPIKYVLYQDDRSKHWRVQAVAVAPDKFESRKPLPSQWRGLRDDELSREAGIPGCVFVHMSGFIGGNQNYEGALAMAKDALKL

SEQ ID NO: 2977 - protein, 344 aa, Vitis vinifera
METSKLFLLSSSLLLVLLATRPCPSLSERCNPKDKKVLLQIKKALDNPYILASWNPNTDCCGWYCVECDLTTHRINSLTIFSGQLSGQIPDAVGDLPFLETLIFRKLSNLTGQIPPAIAKLKHLKMVRLSWTNLSGPVPAFFSELKNLTYLDLSFNNLSGPIPGSLSLLPNLGALHLDRNHLTGPIPDSFGKFAGSTPGLHLSHNQLSGKIPYSFRGFDPNVMDLSRNKLEGDLSIFFNANKSTQIVDFSRNLFQFDLSRVEFPKSLTSLDLSHNKIAGSLPEMMTSLDLQFLNVSYNRLCGKIPVGGKLQSFDYDSYFHNRCLCGAPLQSCKITRNIINKKEK

SEQ ID NO: 2978 - protein, 360 aa, Vitis vinifera
MAVLISLLLALSSVFFTGPAFAGTYLEGLLPNGNFEESPKPTDLKKTVIKGKYSLPKWEINGSVEYIAGGPQPGGMFFAVAHGVHAVRLGNEASISQTIPVKPGSLYALTFGASRTCAQDEVLRVSVPPQTGDLPLQTLYDSFGGDVYAWGFRATSNEAKVTFHNTGVQEDPACGPLLDAVAIKELFPPMPTRDNLVKNSGFEEGPHLLINSSNGVLLPPKQEDLTSPLPGWIIESLKAVKFIDKKHFNVPFGLAAVELLAGRESAIAQVLRTVPNKLYNLTFSIGDGKNGCHGDMMIEAFAAKDSFKAPFKSRGKGEFKTVSFKFKAIAARTRLTFFSSFYHTRIDDFGSLCGPVLDQP

SEQ ID NO: 2979 - protein, 386 aa, Vitis vinifera
MAKSVLILCGDYMEDYEVMVPFQALLAYGVSVHAVCPGKKAGDVCRTAVHQGLGHQTYSESRGHNFTVNATFDEVDASKYDGLVIPGGRAPEYLAMNESVLDLVRKFFSSGKPIASICHGQLILAASGSVRGRKCTAYPAVGPALIAAGAHWVEPETMSACVIDGNLITAATYIGHPGFIQLFVKALGGTITGSDKRILFLCGDYMEDYEVMVPFQSFQALECHVDAVCPKKKAGETCPTAIHDFEGDQTYSEKPGHDFTLTATFEDLNIPSYDALVIPGGRAPEYLALNEKVIALVKEFMEAGKPVASICHGQQILAAAGVLKGKKCTAYPAVKLNVVLSGATWLEPEPIDRCFTDGNLVTGAAWPGHPEFISQLMTLLGIQVLF

SEQ ID NO: 2980 - protein, 390 aa, Vitis vinifera
MLRGLAFNPKILHFSPSLPLFSLNSPSFSSRLPSFSGRKNSILQAQGLGFKSENQLGTTMDLGKEVPELNRNLYPPIEPYSSGFLKVSDLHSIYWEQSGNPNGHPVVFIHGGPGGGTSPSNRTFFDPDFYRIILFDQRGAGKSTPHACLVDNTTWDLVNDIEKLREHLEIPEWQVFGGSWGSTLALAYSQSHPDKVTGMVLRGIFLLRKKELDWFYEGGAAAIYPDAWEPFRDLIPENERDCLIDAYHKRLNSDDMETQYAAARAWTKWEMMTAHLLPNEENIKKGDDDKFSLAFARIENHYFVNKGFFPSDSFLLDNIEKIRHINATIVQGRYDMCCPIMTAWDLHKAWPEADFKIVPDAGHSANELGIAAELVAANEKLKNIIKNGGP

SEQ ID NO: 2981 - protein, 394 aa, Vitis vinifera
MPPKSSKSKEAPAERPILGRFSSHLKIGIVGLPNVGKSTLFNTLTKLAIPAENFPFCTIEPNEARVNIPDERFEWLCQLYKPKSEVSAFLEIHDIAGLVRGAHQGQGLGNSFLSHIRAVDGIFHVLRAFEDPDIIHVDDSVDPVRDLEVISEELRLKDIEFIEKRIEDVEKSMKRSNDKQLKIELELCLKVKAFLEDGKDIRLGDWKAADVEILNTFQLLTAKPVVYLVNMNEKDYQRKKNKFLPKIHAWVQDHGGETIIPFSCALERNLADMPEDEAAKYCEENKVQSALPKIIKTGFSAINLIYFFTAGPDEVKCWQIRRQTKAPQAAGTIHSDFERGFICAEVMKFDDLKELGSEGAVKAAGKYRQEGKTYVVQDADIIFFKFNVSGGGKK

SEQ ID NO: 2982 - protein, 394 aa, Vitis vinifera
MSSYGMLARRVVETETPVMVQIQELIRGAGDAMSLAQGVVYWQPPKQALEKVKDLVWEPSVSRYGADDGLPELREALVEKLRQENKLYKSSVMVTAGANQAFVNLVLTLCDAGDLVVMFAPYYFNAYMSFQMTGVTNILVGPSNPKTLHPDADWLEKILLETKPAPKVVTVVNPGNPSGTYIPEPLLKRFADLCRNAGSWLVVDNTYEYFMYDGLKHTCVEGDHIVNIFSFSKAYGMMGWRVGYIAYPSNVEGLGAQLLKVQDNIPICASIFSQHLALYSLEMGPEWVTKQVKSLVINRSLIMDALSPLGKDSVKGGEGAIYLFAKLPDKYHDDFEVVRWLARKHRVVVIPGSACGTPGSLRVSFGGLREDETQIAAGRLKKGIEELVRDGMLQ

SEQ ID NO: 2983 - protein, 399 aa, Vitis vinifera
MKFLWKMDTFLFTSESVNEGHPDKLCDQISDAVLDACLEQDPDSKVACETCTKTNLVMIFGEITTKANLDYEKIVRDTCRAVGFVSEDVGLDADNCKVLVNIEQQSPDIAQGVHGHLTKRPEEIGAGDQGHMFGYATDETPELMPLSHVLATKLGARLTEVRKNGTCPWLRPDGKTQVTVEYFNDHGAMVPIRVHTVLISTQHDETVTNDEIAADLKEHVIKPIVPEKFLDEKTIFHLNPSGRFVIGGPHGDAGLTGRKIIIDTYGGWGAHGGGAFSGKDPTKVDRSGAYIVRQAAKSIVASGLARRCIVQVSYAIGVPEPLSVFVDTYATGKIPDKEILKIVKESFDFRPGMIAINLDLKRGGNGRFLKTAAYGHFGRDDPDFTWEVVKPLKAEKAQE

SEQ ID NO: 2984 - protein, 417 aa, Vitis vinifera
MFGRAPKKSDNTRYYETLGVSKNASQDDLKKAYRKAAIKNHPDKGGDPEKFKELAQAYEVLSDPEKREIYDQYGEDALKEGMGGSGGGHDPFDIFQSFFGGSPFGGGGSSRGRRQRRGEDVVHPLKVSLEDLYIGTSKKLSLSRNVICSKCNGKGSKSGASIKCNGCQGSGMKVSIRQLGPSMIQQMQHPCNECKGTGETINDKDRCPQCKGEKVVQEKKVLEVIVEKGMQNGQKVTFPGEADEAPDTVTGDIVFVLQQKEHPKFKRKGDDLFVEHTLSLTEALCGFQFILTHLDGRQLLIKSNPGEVVKPDQFKAINDEGMPIYQRPFMRGKLYIQFNVEFPDTLSPEQCKALEAVLPARATTQLTDMELDECEETTLHDVNIEEEMRRKQAQAQEAYEEDEEMPGGAQRVQCAQQ

SEQ ID NO: 2985 - protein, 423 aa, Vitis vinifera
MASAMVEDSSFEDDQLASMSTDDIARASRLLDNEIRILKEELQRTNLELESFKEKIKENQEKIKLNKQLPYLVGNIVEILEMNPEDEAEEDGANVDLDSQRKGKCVVLKTSTRQTIFLPVVGLVDPDKLKPGDLVGVNKDSYLILDTLPSEYDSRVKAMEVDEKPTEDYNDIGGLEKQIQELVEAIVLPMTHKERFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDDRIKVIAATNRADILDPALMRSGRLDRKIEFPHPSEDARARILQIHSRKMNVHPDVNFEELARSTDDFNGAQLKAVCVEAGMLALRRDATEVIHEDFNEGIIQVQAKKKSSLNYYA

SEQ ID NO: 2986 - protein, 434 aa, Vitis vinifera
MAEAFSLSLTPPQMASLSGAAAASSRLLPRARLGFSTSSSTPSPSSLSLSSLKGLRSSPLLSHLLHRQKTTSVRASSGGLGFSSVAAPKCSASDPDQLKSAREDIKELLKSKFCHPLLVRLGWHDAGTYNKNIEEWPLRGGANGSLRFEIELKHGANAGLVNAVKLLQPIKDKYSGVTYADLFQLASATAVEEAGGPKIPMKYGRVDASGPEQCPEEGRLPDAGPPSPADHLRDVFYRMGLNDKEIVALSGAHTLGRSRPERSGWGKPETKYTKDGPGAPGGQSWTVQWLKFDNSYFKDIKEKIDEELLVLPTDAILFEDPSFKVYAEKYAVDQEAFFKDYAEAHAKLSNLGAKFDPPEGIVIDDGPAEAAPEKFVAAKYSSGKKELSEAMKQKIRAEYEAVGGSPDKPLQSNYFLNIMIVIAVLAFLTTLFGN

SEQ ID NO: 2987 - protein, 437 aa, Vitis vinifera
MADAHETDKNIEIWKIKKLIKALEAARGNGTSMISLVMPPRDQISRVTKMLGDEFGTASNIKSRVNRQSVLGAITSAQQRLKLYNKVPPNGLVLYTGTIVTEDGKDKKVTIDFEPFRPINASLYLCDNKFHTEDMNELLESDDKFGFIVMDGNGTLFGTLSGNTREVLHKFTVDLPKKHGRGGQSALRFARLRMEKRHNYVRKTAELATQFFINPATSQPNVAGLILAGSADFKTELSQSDMFDPRLQAKLLNVVDVSYGGENGFNQAIELSSEILSNVKFIQEKRLIGKYFEEISRDTGKYVFGVDDTLKALEMGAVEILIMWENLDINRYVLNNSNTTEIVIKHLNKEQATDQSNFRDSATSAELEVQEKMSLLEWFANEYKRFGCALEFVTNKSQEGSQFCRGFGGIGGILRYQLDMRLFDEVSDDGENYEDSD

SEQ ID NO: 2988 - protein, 433 aa, Vitis vinifera
MALVLHAGKTNKNAYKTLIAAEYSGIKVELVQNFEMGVSNKTPEFLKMNPIGKVPVLETPDGPVFESNAIARYVTRLKADNPLYGSSPIEYGHIEQWIDFASLEIDANIGHWFRPRIGRAVYLPPFEEAAIAALKRALGALNTHLASNTFLVGHSVTLADIVMTCNLYMGFSKLMTKSFTSEFPHVERYFWTMVNQPNFSKILGEVKQTASVPPVSSAKKPALPKEHAKPKHKDEPKKEVKKEPAKPKEAPVGEEEEAPKPKPKNPLDLLPPSKMILDEWKRLYSNTKTNFREVAIKGFWDMYDPEGYSLWFCDYKYNDENTVSFVTLNKVGGFLQRMDLARKYAFGKMLVIGSEAPFKVKGLWLFRGQEIPQFIIDECYDMELYEWKKVDISDEAQKERVNQMIEDQEPFEGEALLDAKCFKKWGKNVRKRK

SEQ ID NO: 2989 - protein, 463 aa, Vitis vinifera
MMQPAPGVVPPSMQPAPMDQQQPPQYQQPPPQQQWMMMPPPQQQQQTQPPPAWAQQAPVPPPQAQPQMAPPPQQQQYVAAPQASNPEEIRSLWIGDLQPWMEENYLWGCFSQTGEVVSVKVIRNKQTGQCEGYGFIELATRAAAERILQTYNGTLMPNSEQNFRLNWATLGAGERRADDTPDYTIFVGDLASDVTDYVLQETFRGHYPSVKGAKVVTDRTTGRSKGYGFVRFGDEGEQLRAMNEMNGMFCSTRPMRIGPAATKKPVGGQQFQKASFQNTQGNQGESDPNNTTIFVGGLDSNVTDDYLRQVFSQYGELVHVKIPVGKRCGFVQFANRACAEQALAGLNGTQLGAQSIRLSWGRSPSNKQAQPDQAQWNGGYYGYAQGYEAYGYAPPPQDPNMYYGAYPGYGNYQQPQQGKASMLIKLESPVLSHSAWLDENCRTLDATCLLVGPDLRKILLICC

SEQ ID NO: 2990 - protein, 500 aa, Vitis vinifera
MNLPLLGGKDPGSAVMANSNSEFDLKDFRIPDYILVPESEVEAVSYVPECPVIVFINSKSGGQLGGDLLITYRSLLNEKQVFDVNQEAPDKSLSRIYVNLEKLKHSEDDFAFKIQERLRIIVAGGDGTAGWLLGVVSDLKLSQPPPIATVPLGTGNNLPFSFGWGKKNPGTDSRSVESFLGQVKKAKEMKIDSWHFLMRMKAPKEGSCDPIAPLELPHSLHAFHRVSETDSLNMEGYHTFRGGFWNYFSMGMDAQVSYAFHTERKLHPEKFTNQLVNQGTYARLGCTQGWFAASLFHPASKNIAQVAKISVMKKVGGHWEELKISNSIRSIVCLNLPSFSGGFNPWGTPNARRRRDRDLTAPFVDDRLIEVVGFRDAWHGLVLLAPKGHGTRLAQAHRIRFEFHKGSADHTFMRIDGEPWKQPLPDDDDTVMVEISHLGQVKMLATDNCKSKSCEDPTSPPAPETEEPDSNEEEEGEEWKKFGAAETFRIPDDVDISHLS

SEQ ID NO: 2991 - protein, 502 aa, Vitis vinifera
MAQLQAISSYSSTDLLFRRPKLESSPYHDKLYWWRQLPFVPELGTRGSGINGQAIVHNNGSLFQNLTRVHSNQAIRAVVSSEKETVTSGASNGGLRGKLNKVVLAYSGGLDTSVIVPWLRQNYGCEVVCFTADVGQGIKELEGLEEKAKASGACQLVVKDLKEEFVKDYIFPCLRAGAIYERKYLLGTSMARPVIAKAMVDVAKEVGADAVSHGCTGKGNDQACIEIVRFELTFFALNPELNVVAPWREWEIRGREDAIEYAKKHNVPVPVTKKSIYSRDRNLWHLSHEGDILEDPENEPKNDMYMMSVDPEHAPDQPEYIEIGMVSGLPVSVNGKELSPASLLSKLNEIGGRHGIGRIDMVENRLVGMKSRGVYETPGGTILFTAARELESLTLDRESIQQKDSLALKYAELVYAGRWFDPIRESIDAFMKKITETTTGSVRLKLYKGSVTVAGLKSPYSLYRQDISSFESGQIYDQADAAGFIRLYGLPMKVRAMLEKGI

SEQ ID NO: 2992 - protein, 513 aa, Vitis vinifera
MAEDAPKPKQLWGDVEDDPPSSSSTPAVDLPVESLTIHDEAKEAESLDEPKDSSIQAVTSGDTPYTSASTFEDLNLSPELLRGIYSEMKFERPSKIQAISLPMILTPPYKNLIAQAHNGSGKTTCFVLGMLSRVDPKLQVPQALCICPTRELAIQNLEVLRKMGKHTGIESECAIPMDSANYTSISQRPPVKAQVVIGTPGTVKKWMSHRKLGISNMKILVFDEADHMLAEDGFKDDSLRIMKAIEKSGAQCQVLLFSATFNDTVKNFVTRIVKDYNQMFVKKEELSLQSVKQYKVKCPDELSKILVIKDKIFEIGQKLGQTIIFVRTKNSAGMLHKALVDFGYEVTTIQGALRQEDRDKIIKEFKDGLTQVLISTDLLARGFDQSRVNLVVNYDLPLKYGTQAEPDYEVYLHRIGRAGRFGRKGAVFNLLCSDKDNILISKIENHFGVQIAECRPPPFVDQSLGRDMQPAPGVPLLPFMRRYAAMLSLFCHSGASGMVTFRANVLYGHVRGV

SEQ ID NO: 2993 - protein, 542 aa, Vitis vinifera
MAQNGGIILLLCATFSVLAMVGAEDPYRFFEWNVTYGDIYPLGVRQQGILINGQFPGPDIYSVTNDNLIINVHNSLPEPFLISWNGVQQRRNSFEDGVYGTTCPIPPGKNFTYILQVKDQIGSFFYFPSLAFHKAAGGFGGIRILSRPRIPVPFPDPAGDYTILIGDWYTHNHNTLKAILDRGRRLPFPDGILINGRGANAASFTVERGKTYRLRISNVGLQNSLNFRIQGHKMTLVEVEGTHTLQTSYSSLDVHVGQSYSVLVTADQAAKDYYIAVSSRFTEKVLTSSAVLHYSNSVSPVSGPLPGGPTTQIDYSLNQARSIRTNLTASGPRPNPQGSYHYGLINITRTIKLGNTAGQVNGKQRYAVNSVSFIPADTPLKLADYFKIGGVFRIGSIPDQPSGKKMYLDTSVMGADFRAFVEIVFENRESIIQSWHLDGYSFWVVGMNGGVWTPASRNQYNLRDAVSRCTTQVYPKSWTAVYIALDNVGMWNLRTEFWARQYLGQQFYLRVYSPVGSIRDEYPIPKNALLCGRAAGRKTRSL

SEQ ID NO: 2994 - protein, 583 aa, Vitis vinifera
MAATASPVVLSLVSSLFASASSSSCSSLIFTRLRSSPSLPFSFAVKPLCFRRGKLMAHTLARATLGLTHPSNVEPPKISFTAKEIDLVEWKGDILAVGVTEKDMAKDENLKFENPILKKLDSQLGGLLAEASSEEDFTGKSGQSTILRLPGLGSKRVGLIGLGQLTPCSPPAAYRSLGETVAVAAKAAQASDVAIVLASSEGLSAESKIYTASAIASGAVLGIHEDNRFKSESKKPALKSVDIIGLGTGPDVQKKLKYAEDVCSGVIFGKELVNAPANVLTPGVLAEEASKIASAYSDVLSAKILDAEQCKELKMGSYLGVAAASANPPHFIHLCYKPLTGPVKAKLGLVGKGLTFDSGGYNIKTGPGCSIELMKFDMGGSAAVLGAAKAIGQIKPSGVEVHFIVAACENMISGTGMRPGDVVTASNGKTIEVNNTDAEGRLTLADALVYACNQGVEKIVDLATLTGACVVALGPSIAGVFTPSDDLAKEVLAASEASGEKLWRMPMEESYWESMKSGVADMVNTGGRPGGAITAALFLKQFVDEKVQWMHIDMAGPVWNDKKRAATGFGISTLVEWVLKNSS

SEQ ID NO: 2995 - protein, 642 aa, Vitis vinifera
MKDTDFFFSALLKLVEGSSLSSPKFQDGLRLPHLRSQILLFPNCPFLFSHFHCSEMAMIDEPLYPIAVLIDELKNEDIQLRLNSIRRLSTIARALGEERTRKELIPFLSENNDDDDEVLLAMAEELGVFIPYVGGVEHANVLLPPLETLCTVEETCVRDKAVESLCRIGAQMREPDLVESFIPLVKRLAAGEWFTARVSSCGLFHIAYPSAPETLKTELRAIYSQLCQDDMPMVRRSAASNLGKFAATVEAAHLKADIMSIFEDLTQDDQDSVRLLAVEGCAALGKLLEPQDCVAHILPVIVNFSQDKSWRVRYMVANQLYELCEAVGPEPTRSDLVPAYVRLLRDNEAEVRIAAAGKVTKFCRILNPELAIQHILPCVKELSSDSSQHVRSALASVIMGMAPVLGKDATIDQLLPIFLSLLKDEFPDVRLNIISKLDQVNQVIGIDLLSQSLLPAIVELAEDRHWRVRLAIIEYIPLLASQLGVGFFDDKLGALCMQWLKDKVYSIRDAAANNVKRLAEEFGPDWAMQHIIPQVLDMINNPHYLYRMTILHAISLLAPVMGPEITCSKLLPVVINAAKDRVPNIKFNVAKVLQSLTPIVDQSVVDKTIRPCLVELSEDPDVDVRFFASQALQASDQIMMSS

SEQ ID NO: 2996 - protein, 690 aa, Vitis vinifera
MAEEVQYSSGTDATNKRKYEDQTTPSQPSTRRPTGFSAPISTPSPDSSHAPPSYNSVPPPADEIQLAKQRAQEIAARLFSNASNTEAKRPRVENGAGAGGFDSGDKGFSSAPSDVGQKPMISTPSAIPVSYGYQGTSKKIDIPNGRVGVIIGKGGETIKYLQLQSGAKIQVTRDMDADPNSPTRLVELMGTPDQIAKAEQLINDVLSEAEAGGSGIVSRRLTGQAGSEQFVMKVPNNKVGLIIGKGGETIKNMQARTGARIQVIPLHLPPGDTSMERTVQIDGTSEQIESAKQLVNEVISENRIRNPAMAGGYPQQGYQARPPSGWGAPPGAPPMQQPGYSYAQPGSYPGPSPQYNMSQPAYAGYSQPNATGWDQTAAPPSQQTTPGSGYDYYGQQQTQQQQQAHGGPSGPADNSGYNYNQPPASGYNQQGQGYPQDGYGGGYHAPAPQPGYGQPQPIPGYDQQQGYNSATGYGNVANPTQEGHTTSYGAQGETGQAPPSVQPSAIGQQGYNTQQPSPSPASYPPQGSNQPAYGMPPTSQTGFGSQPPAQSGYTTNYGPPQAQKAPANPPVYGQTQQSPSAQGGYAQPAPVQPGYPHSQQPPAQSGYAQTDSSSQRAAPSSYGTAAGQPGYGGPSAYSAPTVTQAGYGQQPPYSGSYGGGYSQPPMYAADATPTSQPAQQSGVAKTSPQS

SEQ ID NO: 2997 - protein, 739 aa, Vitis vinifera
MAGRSGHDSSMIVTNTPARDLVHTNFAYCSPSDLRKFAVHGSNLALASVGDSCMFIYTAHESIPNGHIALNAIQRRHARVSTGDSVSVSRFIPPDDFNLALLTLELEFVKKGTKDEQIDAVQLSQQLRKRFINQVMTTGQRVTFEYHGNGYIFTVNQAVIEGQEKSKGIERGIIAAETYIIFEAPNSSGIKIVNQREAASSNIFRQKEFNLQSLGIGGLSAEFADIFRRAFASRVFPSHVTSRLGIKHVKGMLLYGPPGTGKTLMARQIGKMLNGREPKIVNGPEVLSKFVGETEKNVRDLFADAENDQRTRGDQSDLHVIIFDEIDAICKSRGSTRDGTGVHDSIVNQLLTKIDGVESLNNVLLIGMTNRKDLLDEALLRPGRLEVQVEISLPDENGRLQILQIHTNKMKENSFLAPDVNLQELAARTKNYSGAELEGVVKSAVSFALNRQLSMDDLTKPVDEESIKVTMEDFLNALQEIIPAFGASTDDLERCRVNGMAECGSRHEHIYQRAMLLVEQVKVSKGSPLITCLLEGPSGSGKTSLAATVGIDSDFPYVKIISAESMIGLSESSKCARIVKVFEDAYKSQLSIIVLDDIERLIEYVAIGPRFSNIISQTLLVLIKRLPPKGKNVLVIGTTSEVSFLDSVGIRDAFSVTYHVPTLKTEDAKKVLQQLNVFSDDDIDSAAEALNDMPIKKLYMLIEMAAQGEHGGEAEAIYSGKEKIAISHFFDCLQDMIRY

SEQ ID NO: 2998 - protein, 734 aa, Vitis vinifera
MALRFPRFSQGLAQDPTTRRIWFGIATAHDFESHDDITEERLYQNIFASHFGQLAIIFLWTSGNLFHVAWQGNFESWVQDPLHVRPIAHAIWDPHFGQPAVEAFTRGGAPGPVNIAYSGVYQWWYTIGLRTNEDLYTGALFLLFLSAISLIAGWLHLQPKWKPSVSWFKNAESRLNHHLSGLFGVSSLAWTGHLVHVAIPGSRGEYVRWNNFLDVLPHPQGLGPLFTGQWNLYAQNPDSSSHLFGTSQGAGTAILTLLGGFHPQTQSLWLTDIAHHHLAIAFIFLVAGHMYRTNFGIGHSMKDLLEAHIPPGGRLGRGHKGLYDTINNSIHFQLGLALASLGVITSLVAQHMYSLPAYAFIAQDFTTQAALYTHHQYIAGFIMTGAFAHGAIFFIRDYNPEQNEDNVLARMLDHKEAIISHLSWASLFLGFHTLGLYVHNDVMLAFGTPEKQILIEPIFAQWIQSAHGKTSYGFDVLLSSTTGPAFNAGRSIWLPGWLNAVNENSNSLFLTIGPGDFLVHHAIALGLHTTTLILVKGALDARGSKLMPDKKDFGYSFPCDGPGRGGTCDISAWDAFYLAVFWMLNTIGWVTFYWHWKHITLWQGNVSQFNESSTYLMGWLRDYLWLNSSQLINGYNPFGMNSLSVWAWMFLFGHLVWATGFMFLISWRGYWQELIETLAWAHERTPLANLIRWRDKPVALSIVQARLVGLAHFSVGYIFTYAAFLIASTSGKFG

SEQ ID NO: 2999 - protein, 840 aa, Vitis vinifera
MYGSVGLFSTPLLGSSSTPSSRNHYKTGSGNKYCLAKQQPIRVSNGPRLQKLLGHCTFHCPSRNSTYGKVNGSAISALITDDNSAMATMGEDTEHIGILDTDPGLEPFKDHFRYRMRRYVEQKELIEKYEGSLEEFAQGYLKFGFNREEGGIVYREWAPAAQEAQVIGDFNGWDGSNHRMERNQFGVWSIKIPDSGGNPAIPHNSRVKFRFKHGDGVWVDRIPAWIRYATVDPTAFAAPYDGVYWDPPPSERYQFKYPCPSKPNAPRIYEAHVGMSSSEPRVNSYREFADDILPRIRANNYNTVQLMAVMEHSYYASFGYHVTNFFAVSSRSGTPEDLKYLIDKAHSLGLRVLMDVVHSHASNNVTDGLNGFDVGQSSQDSYFHTGDRGYHELWDSKLFNYANWEVLRFLISNLRWWLEEFKFDGFRFDGVTSMLYHHHGVNMTFTGNYNEYFSEATDVDAVVYLMLANCLIHKIFPDATVSAEDVSGMPGLGRPVAEGGTGFDYRLAMAIPDKWIDYLKNKKDEEWSMKEISSSLTNRRYAEKCISYAESHDQALVGDKTIAFLLMDKEMYSGMSCLTDASPTIDRGISLHKMIHFITMALGGEGFLNFMGNEFGHPEWIDFPREGNDWSYEKCRRQWELVDTDHLRYKYMNAFDTAMNLLDEKFSFLASTKQIVSSTDEEHKVIVFERGDLVFVFNFHPENTYDGYKVGCDLPGKYRVALDSDACVFGGQGRVGHDADHFTSPEGIPGVPETNFNNRPNSFKVLSPARTCVVYYRVEESLEESDDDHNSTGANATLVADVVAEQESLEEPASVKDHEFKPRLIEGSEVEDVVEEATDD

SEQ ID NO: 3000 - protein, 945 aa, Vitis vinifera
MADQYSCEGSSLSPVSGDCSESTVELNVKTLDSRIHSFHVDKNLPVSLFKEKIANEIGVPVEQQRLIFRGKVLKDDQLLAEYHVENGHTLHLVARDPTQSQPSSGQSSGETNGNNGSRGNDANAGGPRARVGQISHSVVLGTFNVGEQAEGIVPDLTRVIGAVLNSFGIGSQTTNTATGGAQPNTQSNAPGQASQGIEVDGTHGNANGQRQEGNQAQPSQPFQSLPQVMQFPVPGGAGPAPQIQVPIPDSLHTLSEFMNRMGLSLSHNVYQPNSSPTNADIPRVELPSNSRGLPTPEALSIVMRQAERLLSGNAVAALSHIAGRVEQEGASTDPTIRGEIQTEAMQVGLAMQHLGVLLLELGRTILTLRMGQSPDESSVNAGPAVYISPSGPNPIMVQPFPLQTSSFFGGSTVPQSNPPAGPGNAPRHINIHIHAGTSLPPIVSAAGTRAGNGDGMQGERANGNVSAQSDASISQAPSDSGALSSVIAEVNSRIRNLVDNMRGGNQVPSGQAGSSTVQNMSTGSGPGNDVGSDQLKNMAVAGARETSLPSDTCIPGTDGHTSQPEHHQMNNNQDKRGVSQSKDVPSTCAVEGSFSCSSGSDEATSGPADASDDAPRSSQRQDIPEEAKAVPLGLGMGGLQLKKRSKQPKSQGKNNDCGTSSVPSVNQNQRTMTSAQQVLQSLASRGSTANRTDANCPPSQFLSSRSFTANRMDVNRPPSHFLASRSFTANRMDASGPPSGQPLHVLGQVREGMSSGGQGLAEQSGAGSPDVLSNMLQQLSQNPLMMNTVNQIAQQVDGQELESMFSGLGRGQGGGIDLSRMVQQMMPIVSRALSSGPNRGELFHGVGSEPQPQHSERRPSRGDKPDVQNSQTDLREVAESIERQIPPQDIFRSVAENAVQLYANGTGPEGLLDVLCSDEHLATEFMEVLQRDVCNRLHGKSGAKD

SEQ ID NO: 3001 - protein, 880 aa, Vitis vinifera
MEQFRGQPRLPKFAVPKRYDIHLEPDLVACKFAGSVQIDLDIVDATNFIVLNAADLSVAHNAVSFKSQTSSKVFEPSKVEIVEEDEILVLEFSEVLPLEMGVLAIGFEGTLNDKMKGFYRSTFEHNGEKRNMAVTQFEPADARRCFPCWDEPACKATFKITLDVPSDLIALSNMPVIEEKPNGHLKTVSYQESPIMSTYLVAVVIGLFDYVEDHTPDGIKVRVYCQVGKADQGKFALDVAVKTLGLYKEYFACPYSLPKLDMIAIPDFAAGAMENYGLVTYRETALLYDEKHSAAANKQRVATVVAHELAHQWFGNLVTMEWWTHLWLNEGFATWVSYLAADSLFPEWKVWTQFLDESTEGLRLDGLAESHPIEVEINHAGEIDEIFDAISYRKGASVIRMLQSYLGAECFQRSLASYIKKHACSNAKTEDLWAALEEGSGEPVNRLMNSWTKQKGYPVVSVKINNQKLEFEQTQFLSSGSQGDGQWIVPITLCCGSYDTPHNFLLQTKSESLDMKEFLGCCVGGGNDNSIAVCSWIKLNVDQTGFYRVKYDEKLAAGLRSAIEKNYLSATDRFGILDDSFALCMACQQSLTSLLTLMGAYREELDYTVLSNLISISYKVARIAADATPELVDYIKEFFISLFQYSAEKLGWEPRPGEGHLDAMLRGEVLTALAVFGHDLTINEASRRFHAFLDDRNTPVLPPDIRKAAYVAVMQNVTTSNRSGYESLLRVYRETDLSQEKTRILGSLASCPDPNIVLEVLNFVLSSEVRSQDAVFGLAVSREGRETAWSWLKNNWDYISKTWGSGFLITRFVSAIVSPFASFEKASEVQEFFATRTKPSIARTLKQSIERVHINAKWVESIQNEKHLADAMKELAYRKY

SEQ ID NO: 3002 - protein, 906 aa, Vitis vinifera
MPLRLEIKRKLAQRSERVKSVDLHPTEPWILASLYSGTVCIYDYLSQTMIKSFEVTDLPVRSAKFIARKQWVVAGADDMFIRVYNYNTMDKVTIFEAHADYIRCVAVHPTLPYVLSSSDDLLIKLWDWDKGWTCTQIFEGHSHYVMQVTFNPKDTNTFASASLDRTIKIWNLGSPDPNFTLDDHMKGVNCVDYFTGGDKPYLITGSDDQTAKVWDYQTKSCVQTLEGHTHNVSSVCFHPELPIIFTGSEDGTVRIWHATTYRLENTLNYGLERVWALGCMRGSRRVVIGFDEGTIMVKIGRDEPVASMDNSGKIIWAKHNEIQTVNIRSVGADYEVTDGERLPLAVKELGTCDLYPQSLKHNSNGRSVVVCGDGEYIIYTSLAWRNRSFGSALEFVWSSDAEYAVRESTSRIKIFSKTFQEKKNIRPTFSAEHIYGGALLAICSNDFICFYDWAECRLIRRIDVNVKNLYWADSGDLVAIASDSSFYILKYNRDTVVSHFNSGMPSDEQGVEDAFELLHEINERVRTGIWVGDCFIYNNSSWRLNYCVGGEVTTMFHLDRPMYLLGYLASQSRVYLIDKEFNVMGYTLLLNLIEYKTLVMRGDFQRASEILPLIPQEHYNSVARFLEARGMLEDALEVATDPDYRFDLAIQLGRLGTAKEIASEVQSETKWKQLGELAMSNGKFEMAEECLLHAMDLSGLLLLYSSFGDANGISKLVSLAKKQGKNNVAFLCLFTLGKLEECLQLLVESNRIPEAALMARSYLPSKVPEIITIWRNDLNKVSKKAAESLADPEEYPNLFEDWQVALDIESKISEKRGTYPPAEHYLNYAERSNINLMESFKSMQIDEEESILENGNSDHREIQANGASEYQEEAVNVDVNSPDRILVNGNEGEEERGANNEGTSTD

SEQ ID NO: 3003 - protein, 948 aa, Vitis vinifera
MEKSCSLLIYFDKGTPAIANEIKEALEGNDDYAKIEAMKKAIMLLLNGETLPQLFITIVRYVLPSEDHTVQKLLLLYLEIIEKTDAKGKVMPEMILICQNLRNNLQHPNEYIRGVTLRFLCRLNEAEIIEPLIPSVLQNLEHRHPFIRRNAILAVMSIYKLPQGEQLLVDAPEMIEKVLSTEQDPSAKRNAFLMLFTCAQDRAINYLLTHVDRVPEWGELLQMVVLELIRKVCRTNRGEKGKYIKIIISLLNAPSTAVIYECAGTLVSLSSAPTAIRAAANTYCQLLLSQSDNNVKLIVLDRLNELKSSHREIMVDMIMDVLRALSSPNLDIRRKTLDIVLELITPRNINEVVLTLKKEVVKTQSGELEKNGEYRQMLIQAIHSCAIKFPEVASTVVHLLMDFLGDSNVASAIDVVVFVREIIETNPKLRVSIITRLLDTFYQIRAARVCSCALWIIGEYCLSLSEVESGITTIKQCLGDLPFFSVSEEGEASDSSKKVQQVNATTVSSRRPAVLADGTYATQSAASETAFSPPTLVQGSLSSGNLRSLLLTGDFFLGAVVACTLTKLVLRLEEVQPSKAEVNKVSSQALLIMVSMLQLGQSSVLPHPIDNDSYDRIVLCIRLLCNTGDDIRKIWLQSCRQSYVKMLADKQLRETEEIKAKAQISYAQPDDLIDFYHLKSRKGMSQLELEDEVQDDLKRATGEFIKDGDDANKLNRILQLTGFSDPVYAEAYVTVHHYDIVLDVTVINRTKETLQNLCLELATMGDLKLVDRPQNYTLAPESSKQIKANIKVSSTETGVIFGNIVYETSNVHERMVVVLNDIHIDIMDYISPAVCTDVAFRTMWAEFEWENKVAVNTVLQNEKEFLEHIIKSTNMKCLTASSALDGDCGFLAANLYAKSVFGEDALVNISIEKQADGKLSGYIRIRSKTQGIALSLGDKITLKQKGGS

SEQ ID NO: 3004 - protein, 1087 aa, Vitis vinifera
MLPRKRAVAGEVVDDDSDNTGTSSIKKHRISSSAAGTETTVNNNNSGSSLGNNSGNSNHSGGSEVELQIMALGDGHPPDIDEDLHSRQLAVYGRETMRRLFASNVLVSGLQGLGAEIAKNLILAGVKSVTLHDEGTVELWDMSSNFIFSENDVGKNRALASVQKLQELNNAVVISTLTTKLTKEDLSDFQAVVFTDIYFEKAIEFNDYCHSHQPPIAFIKAEVRGLFGSVFCDFGPEFTVFDVDGEEPHTGIIASISNDNPALVSCVDDERLEFQDGDLVVFSEVHGMTELNDGKPRKIKNARPYSFTLEEDTTNFGTYEKGGIVTQVKQPKVLNFKPLREALSDPGDFLLSDFSKFDRPPLLHLAFQALDRFISELGRFPVAGSEEDAQKLIFISSNINEGLGDGKLEDINPKLLRHFAFGARAVLNPMAAMFGGIVGQEVVKACSGKFHPLFQFFYFDSVESLPTEAPDSSDFKPLNSRYDAQISVFGSKLQKKLEDAVVFMVGSGALGCEFLKNVALMGVSCGNQGKLTITDDDVIEKSNLSRQFLFRDWNIGQAKSTVAASAAQTINPCLHIEALQNRVGPETENVFNDAFWENLSVVINALDNVNARLYVDQRCLYFQKPLLESGTLGAKCNTQMVIPHLTENYGASRDPPEKQAPMCTVHSFPHNIDHCLTWARSEFEGLLEKTPAEVNAFLSNPTEYASAMRNAGDAQARDNLERVLECLERERCETFQDCITWARLRFEDYFVNRVKQLIFTFPEDAATSTGAPFWSAPKRFPHPLQFSAADAGHLYFVMAASILRAETFGIPIPDWAKHPKKLAEAVDKVIVPEFQPKTDVKIVTDEKATSLSTASVDDAAVINELLAKIEQSWKSLPPGFRMNPIQFEKDDDTNYHMDLIAGLANMRARNYSIPEVDKLKAKFIAGRIIPAIATSTAMATGLVCLELYKVLDGGHKLEDYRNTFANLALPLFSMAEPVPPKVIKHRDMSWTVWDRWILKDNPTLRELLQWLKDKGLNAYSISCGSCLLYNSMFPRHRERMDKKVVDLAREVAKVELPAYRSHLDVVVACEDDEDNDIDIPQVSIYFG

SEQ ID NO: 3005 - protein, 1115 aa, Vitis vinifera
MTLMTPPPLDQEDDEMLVPHTDFADGPQPMEVAQPDTASAVDAQTVEDPPSARFTWTIENFSRLNTKKLYSDVFYVGGYKWRVLIFPKGNNVDHLSMYLDVADSATLPYGWSRYAQFSLAVINQIHNKFTIRKDTQHQFNARESDWGFTSFMPLGELYDPARGYLVNDTCIVEADVAVRRVIDYWTHDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEIHGLQDARKGVLFIDFPPVLQLQLKRFEYDFMRDTMVKINDRYEFPLQLDLDRENGKYLSPDADRSVRNLYTLHSVLVHSGGVHGGHYYAYIRPTLSDQWFKFDDERVTKEDIKRALEEQYGGEEELPQTNPGFNNSPFKFTKYSNAYMLVYIRESDKEKIICNVDEKDIAEHLRIRLKKEQEEKEQKRKEKAEAHLYTIIKVARNEDLIEQIGRDIYFDLVDHDKVRSFRIQKQTPFNLFKEEVAKEFGIPVQFQRFWLWAKRQNHTYRPNRPLTLQEEAQSVGQLREVSNKANHAELKLFLEVELGQDLRPVPPPEKTKEEILLFFKLYDPLKEELRYVGRLFVKGSGKPIEILSKLNELAGFSPNEEIELFEEIKFEPNVMCEHIDKRLTFRASQLEDGDIICYQRLLQIDSSQQCRYPDVPSFLEYVHNRQVVRFRSLEKPKEDEFCLELSKLFNYDDVVERVAAHLGLDDSSKIRLTSHNCYSQQPKPQPIKYRGVEHLSDMLLHYNQTSDILYYEVLDIPLPELQGLKTLKVAFHHATKEEVVIHTIRLPKQSTVGDVINDLKSKVELSHPNAELRLLEVFYHKIYKIFPLNEKIENINDQYWTLRAEEIPEEEKNLGPHDRLIHVYHFMKDTTQNQVQVQNFGEPFFLVIHEGETLAEVKVRIQKKLQVPDEEFSKWKFAFLSLGRPEYLQDSDIVSSRFQRRDVYGAWEQYLGLEHSDNAPKRSYAANQNRHTFEKPVKIYN

SEQ ID NO: 3006 - protein, 496 aa, Cicer arietinum
MAKLLALSLSFCFLLFGTCFALRDQPQQNECQLEHLNALKPDNRIKSEGGLIETWNPSNKQFACAGVALSRATLQPNSLLQTFLHQRSPEIFIQQGNGYFGMVFPGCVETFEEPRESEQGEGSKFSDSHQKVNRFREGDIIAVPTGVVFWMFNDQDTPVIAVSLIDTSSFQNQLDQMPRRFYLAGNHEQEFLRYQQEGSEEEENEGGNIFSGFKRDFLEDALNVNRRIVNKLQGRNEDEEKGAIVKVKGGLSITTPPEKEPRQKRGSRQEEDEDEDEKRQPHRHSRQDEDEDEKRQPHHHSRGGSKSQRDNGFEETICTARLHQNIGSSSSPDIYNPQAGRIKTVTSFDLQALRFLKLSAEFGSLHKNAMFVPHYNLNANSILYALKGRARLLYALNCKGNSVFDGELEAGRALIVPQNFAIAAKSLSDRFSYVAFKTNDRALINVCQKKLLQLLSIWKEMRPGSSSSTAPFHFLFHPAVTQTTKQQLDLVPNQYE

SEQ ID NO: 3007 - protein, 453 aa, Cicer arietinum
MIVRFSLPDNENDLKLTRSINRDGEILIPKIFIIISVSQISNGASREFDGISSLKVEVFLSLGFNTVSIALHLGLQDGSRHHCVVEERGCEVLSYFLQTVVLEVLKLLRTFVEPLEKTNVTVFVLEKSLKVVRLKEKRILLIGISHKLRPRKQFLSSTKSGNRALIAILMIEFLLSFRIDDEIERVLLEEQEQKPKQRRGHKDRQQSQSQSQQEADVIVKISREQIEELSKNAKSSSKKSVSSESEPFNLRSRNPIYSNKYGNFFEITPEKNPQLQDLDISLNSVEINEGSLLLPHFNSRATVILVVNEGKGEVELVGLRNENEQENKKEDEEEEEDRKVQVQRFQSRLSSGDVVVIPATHPFSINASSDLFLLGFGINAQNNQRNFLAGEEDNVISQIQRPVKEVAFPGSAEEVDRLLKNQRQSHFANAQPQQKDEESQKIRIPLSSILGGF

SEQ ID NO: 3008 - protein, 763 aa, Cicer arietinum
MGSHIVGYPRMGPKRELKFALESFWDGKSSAEDLKKVSADLRASIWKQMSDAGIKYIPSNTFSYYDQVLDATATLGAVPPRYGWTGGEVGFDTYFSMARGNATIPAMEMTKWFDTNYHFIVPELGPDVNFTYASHKAVEEYKEAKALGVDTVPVLIGPVSYLLLSKPAKGVDKSFSLLSLLPKVLAVYKEVIADLKAAGALFIQFDEPTLVLDLESHKLQAFTDAYAALAPSFSGLHVLVETYFADVPAEAYKTLTSLSGVAAYGFDLVRGPKTLELIKAGFPSDKWIFAGVVDGRNIWANDLAASISTLETLASIVGKERIVVSTSCSLLHTAVDLVNETKLDDEIKSWLAFAAQKIVEVNALANAFSGNKDEAFFSANAAAQASRKSSPRVNNEAVQKAASALKGSDHRRATNVSARLDAQQKKLNLPILPTTTIGSFPQTVELRRVRREFKAKKISEEEYIKAIKEEIRKVVELQEELDIDVLVHGEPERNDMVEYFGEQSSGFAFTANGWVQSYGSRCVKPPIIYGDVSRPKPMTVFWSSLAQSFTKRPTKGMLTGPVTILNWSFVRVDQPRSETCYQIALAIKDEVEDLEKGGIGVIQIDEAALREGLPLRKSEHAHYLDWAVHSFRITNVGVQDSTQIHTHMCYSNFNDIIHSIIDMDADVITIENSRSDEKLLSVFREGVKYGAGIGPGVYDIHSPRIPPTEEIADRINKMLAVLEKNILWVNPDCGLKTRKYTEVRPALENMVAAAKQIRNELAK

SEQ ID NO: 3009 - protein, 227 aa, Cicer arietinum
TKTGYINAAFRSSRNNEAYLFINDKYVLLDYAPGTSNDKVLYGPSFVRDGYKSLAKTIFGTYGIDCSFDTEYNEAFIFYENFCARIDYAPHSDKDKIISGPKKIADMFPFFKGTVFENGIDAAFRSTKGKEVYLFKGDKYARIDYLTNRLVQNIKSISDGFPCLRGTIFEAGMDSAFASHKTNEAYLFKGEYYARINFTPGSTNDIMGGVKKTLDYWPSLRGIIPLE

SEQ ID NO: 3010 - protein, 132 aa, Cicer arietinum
MAKLLALSLSFCFLLFGSCFALRDQPEQNECQLEHLNALEPDNRIKSEGGLIETWNPSNKQFRCAGVALSRATLQPNSLRRPFYTNAPQEIFIQQGNGYFGMVFPGCVETFEEPRESEQGEGSKFRDSHQKV

SEQ ID NO: 3011 - protein, 326 aa, Cicer arietinum
GFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLKLPLQDVYKIGGIGTVPIGRVETGVIKPGVIVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGLVKMIPTKPMVVETFSEYPPLGRFAVRDMRQTVAVGVIKSVEKKDPTGAKITKAAVKKK

SEQ ID NO: 3012 - protein, 377 aa, Cicer arietinum
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLTKILTERGYMFTTSAEREIVRDIKEKLAYVALDYEQELETAKSSSSIEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 3013 - protein, 167 aa, Cicer arietinum
RSDHVDLAALEIYRDRERNVARYNQFRRGLLMIPISKWEDLTDDKEVIEVLEEVYGDDVEELDVLVGLMAEKKIKGFAISETAFTIFLLMASRRLEADRFFTSNFNEETYTKEGLEWVNTTETLKDVIDRHHPEITNNWLNSSSVFSVWDSPPNKHNPIPIYLRVPS

SEQ ID NO: 3014 - protein, 359 aa, Cicer arietinum
MSNFKSKYHDELIANAAYIGTPGKGILAADESTGTIGKRLASINVENVETNRRALRELLFTAPNVLQYLSGVILFEETLYQSTAAGKPFVDVLNEAGVLPGIKVDKGTVELAGTDGETTTQGLDGLGARCAKYYEAGARFAKWRAVLKIGPNEPSLSILSIENAYGLARYAVICQENGLVPIVELEILVDGSHDIHKCAAITERVLAATYKALSDHHVLLEGTLLKPNMVTPGSDSPKVAPEVVAEHTVRALQRTVPAAVPAVVFLSGGQSEEEATVNLNAINQVKGKKPWTLSFSFGRALQQSTLKAWSGKEENVKNAQDALLTRAKANSEATLGTYKGNSQLGEGASESLHVKDYKY

SEQ ID NO: 3015 - protein, 516 aa, Cicer arietinum
MASMAAIGVLKVPPSSSSSSSSSSSKAIIARNLSFTSSQVCGDKIGTFSRRGRGSYVGNPIIVSPKAVSDSKNAQTCLDPDASRSVLGIILGGGAGTRLYPLTKKRAKPAVPLGANYRLIDIPVSNCLNSNVSKIYVLTQFNSASLNRHLSRAYASNMGGYKNEGFVEGLAAQQSPENPNWFQGTADAVRQYLWLFEEHNVLEYLVLAGDHLYRMDYERFIQAHRESDADITVAALPMDELRATAFGLMKIDEEGRIIEFAEKPKGEQLKAMKVDTTILGLDEERAKEMPYIASMGIYVVSKHVMLDLLREKFPGANDFGSEVIPGATNIGMRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGSVPIGIGKNSHIRRAIIDKNARIGDNVKIINSDNVQEAARETEGYFIKSGIVTVIKDALIPSGTVI

SEQ ID NO: 3016 - protein, 194 aa, Cicer arietinum
EYKPEFDIVSNASCTTNCLAPLAKVINDRFGIVEGLMTTVHSITATQKTVDGPSAKDWRGGRAASFNIIPSSTGAAKAVGKVLPVLNGKLTGMAFRVPTVDVSVVDLTVKLEKAATYDEIKAAINEESEGKLKGILGYTEDDVVSTDFIGDTRSSIFDAKAGIALNDRFVKLVSWFDNELGYSTRVVDLIVHIA

SEQ ID NO: 3017 - protein, 444 aa, Cicer arietinum
MDEEYDVIVLGTGLKECILSGLLSVDGLKVLHMDRNDYYGGESTSLNLIQLWKRFRGDDKPPPHLGSSKDYNIDMNPKFIMANGMLVRVLIHTDVTKYLYFKAVDGSFVFNKGKVHKVPSNDMEALKSPLMGIFEKRRARKFFIYVQDYNESDPKTHDGMDLTRVTTKELIAKFGLDDNTVDFIGHALALHRDDRYLNEPALDTVKRMKLYAESLARFQGGSPYIYPLYGLGELPQAFARLSAVYGGTYMLNKPECKVEFDGEGKVLGVSSEGETAKCKKVVCDPSYLPNKVRKVGKVARAIAIMSHPIPNTNDSHSVQVILPQKQLGRKSDMYLFCCSYSHNVAPKGKFIAFVSTEAETDQPAIELKPGIDLLGPVDEIFFDMYDRFEPVNEPTLDNCFVSTSYDATTHFESTVLDVLNMYTLITGKVLDLSVDLSAAGAAEE

SEQ ID NO: 3018 - protein, 475 aa, Cicer arietinum
MSPQTETKASVGFKAGVKDYKLTYYTPDYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPNAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLSHYCRDNGLLLHIHRAMHAVIDRQKNHGMHFRVLAKALRLSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIRDAAKWSPELAAACEVWKEIKFEFEAMDTL

SEQ ID NO: 3019 - protein, 126 aa, Cicer arietinum
GRSGKPLHFKGSSFHRVIPNFMCQGGDFTAGNGTGGESIYGSKFADENFIKKHTGPGILSMANAGPGTNGSQFFVCTAKTEWLDGKHVVFGQVVEGLDVVKEIEKVGSSSGKTSKPVKIADCGQLS

SEQ ID NO: 3020 - protein, 332 aa, Cicer arietinum
MAKDPVRVLVTGAAGQIGYALVPMIARGVMLGPDQPVILHMLDIPPAAESLNGVKMELVDAAFPLLKGVVATTDVVEACTGVNIAVMVGGFPRKEGMERKDVMSKNVSIYKSQASALEQHAAANCKVLVVANPANTNALILKEFAPSIPEKNISCLTRLDHNRALGQISERLSVQVSEIKNVIIWGNHSSTQYPDVTHATVKTPAGEKPVRELVSDDAWLNGEFIPTVQQRGAAIIKARKLSSALSAASAACDHIRDWVLGTPEGTFVSMGVYSDGSYNVPAGLIYSFPVTCAGGEWKIVQGLSIDEFSRKKLDLTAEELSEEKNLAYSCLS

SEQ ID NO: 3021 - protein, 147 aa, Cicer arietinum
GKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKA

SEQ ID NO: 3022 - protein, 261 aa, Cicer arietinum
MATAPTPREEFVYMAKLAEQAERYEEMVEFMEKVTAAVESEELTVEERNLLSVAYKNVIGARRASWRIISSIEQKEESRGNDEHVAVIRDYRSKIEAELSNICNGILKLLDSRLIPSAASGDSKVFYLKMKGDYHRYLAEFKSGAERKDAAESTLTAYKSAQDIANSELPPTHPIRLGLALNFSVFYYEILNSPDRACGLAKQAFDEAIAELDTLGEESYKDSTLIMQLLRDNLTLWTSDMQDDGADEIKEAAPKGNDEPQ

SEQ ID NO: 3023 - protein, 221 aa, Cicer arietinum
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDLVAQQQHEAEIAQAANQPLPDDDDDAFE

SEQ ID NO: 3024 - protein, 108 aa, Cicer arietinum
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQD

SEQ ID NO: 3025 - protein, 152 aa, Cicer arietinum
MVLAGKLSTELGIKAPASKFYNLFATQLHEVQNHCERVHHTKLQQGEDWHHSDSVKHWKYVIDGKVHTCNESVEEVDEQNKKITYKLFGGDIDEHYKVFKLILQVFDKSDGSGAVKWTIEYEKINEDIYPPNGWMDYLSKCTRDLDGNLVKA

SEQ ID NO: 3026 - protein, 261 aa, Cicer arietinum
MASSKDRENFVYIAKLAEQAERYEEMVDSMKSVANLDVELTVEERNLLSVGYKNVIGARRASWRILSSIEQKEETKGNDVNAKRIKEYRHKVESELSNICNDVMRVIDEHLIPSAAAGESTVFYYKMKGDYYRYLAEFKTGNEKKEAADQSMKAYESATTAAEAELPPTHPIRLGLALNFSVFYYEILNSPERACHLAKQAFDEAISELDTLNEESYKDSTLIMQLLRDNLTLWTSDIPEDGEDSQKVNGTAKLGGGDDAE

SEQ ID NO: 3027 - protein, 540 aa, Cicer arietinum
LPTDILSKISPLPALKEILRTDGEQVLKFPPPHVIQVSKSAWMTDEEFGREMVAGVNPCVIRLLQEFPPKSTLDTIVYGDQSSTITKEHLEVNLGGLTVEEALNGNRLFILDYHDAFMPYLERINLTAKAYATRTILFLKDDGTLKPVAIELSLPHSNGVQYGAESKVFLPSDVGEESTIWLLAKAHVIVNDSCYHQLISHWLNTHATIEPFIIATNRHLSVLHPINKLLYPHYRDTININGLARQALINADGIIEQTFLPGPNSVEISSAVYKNWVFTDQALPADLIKRGLAIEDSSSPHGLRLVIQDYPYAVDGLEIWDAIKTWVQEYASLYYPTDEAVQKDTELQTWWKEAVEKGHGDLKDKPWWPKMQTLQDLVQSCSIIIWTASALHAAVNFGQYPYGGYILNRPTLSRRFIPEKGTPEYDEMVKSPQKAYLRTITPKYQTLVDLSVIEILSRHASDEVYLGERDSKFWTSDSRAVQAFQKFGSKLTEIEGKIIERNKDSSLKNRYGPIQLPYNLLLRSSEEGLTFRGIPNSISI

SEQ ID NO: 3028 - protein, 197 aa, Cicer arietinum
RSDPTQIEVKLFNRWSFDDVQLSDVSLIDYIGVVPSKHATYVPHTAGRYSVKRFRKAQCPIVERLTNSLMMHGRNNGKKLMAVRIIKHAMEIIHLLTDQNPIQVIVDAVVNSGPREDATRIGSAGVVRRQAVDISPLRRVNQAIYLLTTGAREAAFRNIKSIAECLADELINAAKGSSNSYAIKKKDEIERVAKANR

SEQ ID NO: 3029 - protein, 485 aa, Cicer arietinum
MSLIVEKTNTGREYKVKDLSQADFGRLEIELAEIEMPGLISSRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDVTLLIHEGVKAEELFEKTGEVPDPSSTDNAEFQIVLSIIREGLKTDPQRYRKMKQRLVGVSEETTTGVKRLYQMQANGTLLFPAINVNDSVTKSKFDNLYGCRHSLPDGLMRATDVMIAGKVGVVCGYGDVGKGCAVALKQAGARVIVTEIDPICALQALMEGFQVLTLEDVVSIADIFVTTTGNKDIIMVDDMRKMKNNAIVCNIGHFDNEIDMAGLENYPGVKRITIKPQTDRWVFPETNTGIIVLAEGRLMNLGCATGHPSFVMSCSFTNQVIAQLELWNERNSGKYEKKVYVLPKHLDEKVAALHLNKLGAKLTKLSQSQADYISVPVEGPYKPAHYRY

SEQ ID NO: 3030 - protein, 74 aa, Cicer arietinum; identical to SEQ ID NO: 596

SEQ ID NO: 3031 - protein, 233 aa, Cicer arietinum
MAPKQRTARVSRNPDLIRGIGKYSKSAMYHKRGLWAIKAKHGGAFPKHDPKPKPEAPAEKAPKFYPAHDVQKPLRNKHKPKPTKLRANITPGTVLILLAGRFKGKRVVFLKQLPSGLLTCSGPFKINGVPLRRVNQSYVIGTSTKVDVSSVNVDKFDDKYFSKVAEKKTTKGEGEFFDSEKEDKKVLPQEKKDDQKTVDSSLLKAIETVPDLKTNLGARFSLKSGVKPHELVF

SEQ ID NO: 3032 - protein, 139 aa, Cicer arietinum; identical to SEQ ID NO: 573

SEQ ID NO: 3033 - protein, 158 aa, Cicer arietinum
MGVFTFEQETASTVPPAKLYKAMVKDADVIIPKAVDAIKTVETVEGNGGPGTIKKLTFVEGGQTLYVLHKIEAIDEANLGYNYSIVGGAGLSETVERYHFEAKLCEGPNGGSIGKVSVKYQTKGDAKPNEKEVQEGKAKGDALFKAIEGYVLANPNYN

SEQ ID NO: 3034 - protein, 300 aa, Cicer arietinum
MATTTAPSRQLTQKEADIQMMLAADVHLGTKNCNFQMERYIFKRRNDGIYIINLGKTWDKLNLAARIIVAIENSQDIIVQSARPYGQRAVLKFAQYTGAHAIAGRHTPGTFTNQLQTSFSEPRLLILTDPRTDHQPIKEAALGNIPTIAFCDTDSPMNYVDIGIPANNKGKHSIGCLFWLLARMVLQMRGTIRPGLKWDVMVDLFFYREPEEAKQPEEDEVAAPDYAIADFNVSAIPSDGQWPAAIDQPWNDAVPQPIPAVPAVNWAAPEAVAGDWGEAVPPPQQIPTAGIESVPATGWE

SEQ ID NO: 3035 - protein, 152 aa, Cicer arietinum; identical to SEQ ID NO: 547

SEQ ID NO: 3036 - protein, 178 aa, Cicer arietinum
METVMEDVEEYNYREVNLPSLIPVVGEPELERETGERRRGRDIVIAIDHGPNSKHAFDWALIHLCRLADTIHLVHAVSDVKNQIVYDMTQVLMEKLAVEAFQVAMVKTVARIVEGDTGKVICKEAERTKPAAVVMGTRGRSLFQSVLHGSVGEYCFHHCKAAPLVIVPGKDAGDASIV

SEQ ID NO: 3037 - protein, 202 aa, Cicer arietinum
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKCDLAANKVVSSETAKAFADEIGIPFMETSAKNATNVEQAFMAMAAEIKNRMASQPANNARPPTVQIRGQPMNQKSGCCST

SEQ ID NO: 3038 - protein, 346 aa, Cicer arietinum
MAANSSNGDHQTTHKQPPLPSPLRFSKFFQSNMRILVTGGAGFIGSHLVDRLMENEKNEVIVADNYFTGSKDNLKKWIGHPRFELIRHDVTEPLMIEVDQIYHLACPASPIFYKYNPVKTIKTNVIGTLNMLGLAKRVGARILLTSTSEVYGDPLEHPQTESYWGNVNPNGVRNCYDEGKRVAETLMFDYHRQHGIEIRVARIFNTYGPRMNIDDGRVVSNFIAQALRGESLTVQSPGTQTRSFCYVSDLVDGLIRLMGGSDTGPINLGNPGEFTMLELAETVKELINPNVEIKTVENTPDDPRQRKPDITKAKELLGWEPKVKLRDGLPLMEGDFRLRLGVDKKN

SEQ ID NO: 3039 - protein, 77 aa, Cicer arietinum
SVTIEAMAKAFGVSVDFIDVELSRLFAAGKLHCKIDKVAGVLETNRPDAKNALYQATIKQGDFLLNRIQKLSRVIDL

SEQ ID NO: 3040 - protein, 109 aa, Cicer arietinum
MAGSWKCGSLFVLAIISFGCLFAISIAKEEGTKLGTVIGIDLGTTYSCVGVYKNGHVEIIANDQGNRITPSWVAFTDSERLIGEAAKNLAAVNPERTIFDVKRLIGRKF

SEQ ID NO: 3041 - protein, 139 aa, Cicer arietinum
MSSTATTKGGRGKPKASKSVSRSSKAGLQFPVGRIARFLKAGKYAERVGAGAPVYLSAVLEYLAAEVLELAGNAARDNKNNRIVPRHIQLAVRNDEELSKLLGSVTIANGGVLPNIHQTLLPKKVGKGKGEIGSASQEF

SEQ ID NO: 3042 - protein, 155 aa, Cicer arietinum; identical to SEQ ID NO: 522

SEQ ID NO: 3043 - protein, 181 aa, Cicer arietinum
MASSMISSSAVTTVKRASSVPSGAVAPFVGLKSMAGFPVRKVNNDITSIASNGGRVHCMQVWPPIGKKKFETLSYLPPLTEEQLLKEVEYLLRKGWVPCLEFELEKGFVYREHNNSPGYYDGRYWTMWKLPLFGCTEAVQVLKELQEVVKAYPNAFVRIIGFDNVRQVQCISFIAHTPKEF

SEQ ID NO: 3044 - protein, 439 aa, Cicer arietinum
TYTHNHPERIADGSNGDVAIDQYHRYKEDVQIIKDLNMDSYRFSISWSRILPKGKLSGGKNPEGIQYYNNLINESLAHGIKPYITLFHWDLPQALEDEYGGFLNSSIINDFRDYADLCFHEFGDRVKDWVTFNEPWMFSNGGYAVGSLAPGRCSDPTCLGGNSGTEPYTVTHNQILAHAHAVRVYRTKYKAKQNGKIGITLVSNWFLPLRDNVEDELATRRALDFQLGWFMEPLTTGNYSLSMQNIVKTRLPKFTTEQSRLVNGSFDFLGLNYYTSTYISNAPPQENVPPSYTTDSRTNTSSEKNGRPLGPRAASSWLYVYPRGLRDLLLHIKEKYNNPAIYIHENGMDEFNDPTLPVKEALLDTFRIDYYFRHLYYIRSAIQLGANVKAFLAWSLFDNFEWGGGYQHRFGLNYIDYKDGLKRYPKVSAQWYQNFLKRD

SEQ ID NO: 3045 - protein, 611 aa, Agaricus bisporus
  source: /note="var. bisporus"
  source: /note="strain H97 / ATCC MYA-4626 / FGSC 10389"
MSLLATVGPTGGVKNRLDIVDFVRDEKFFTLYIRALQAIQDKDQSDYSSFFQLSGIHGLPFTPWAKPKDTPTVPYESGYCTHSQVLFPTWHRVYVSIYEQILQEAAKGIAKKFTVHKKEWAQAAEDLRQPYWDTGFALVPPDEIIKLEQVKITNYDGTKITVRNPILRYSFHPIDPSFNGYPNFDTWKTTVRNPDADKKENIPALIGKLDLEADSTREKTYNMLKFNANWEAFSNHGEFDDTHANSLEAVHDDIHGFVGRGAIRGHMTHALFAAFDPIFWLHHSNVDRHLSLWQALYPGVWVTQGPEREGSMGFAPGTELNKDSALEPFYETEDKPWTSVPLTDTALLNYSYPDFDKVKGGTPDLVRDYINDHIDRRYGIKKSEGGKNPAQDLLSDFKGVTHDHNEDLKMFDWTIQASWKKFELDDSFAIIFYFAADGSTNVTKENYIGSINIFRGTTPTNCANCRTQDNLVQEGFVHLDRFIARDLDTFDPQAVHRYLKEKKLSYKVVADDHSVTLKSLRIRVQGRPLHLPPGVSFPRLDKNIPIVNFDDVLDLVTGVVNIGLTAVGATAGVAIGVVGATAGTAIGVAGAATDAVTNIAKGGLGALGRIF

SEQ ID NO: 3046 - protein, 388 aa, Agaricus bisporus
  source: /note="var. bisporus"
  source: /note="strain H97 / ATCC MYA-4626 / FGSC 10389"
MSHRKYEAPRHGSLGFLPRKRSARHRGKVKSFPKDDPKKPVHLTAYMGYKAGMTHVVRDLERPGSKMHKREIVEAVTIVETPPMMVVGVVGYVETPRGLRTLTTVWANHLSDELKRRFYKNWYRSKKKAFTRYAKKHAEDGGKSIGRELERIRKYCTVVRVLAHTQIRKTPLSQKKAHLMEIQVNGGSIADKVEFAHGLFEKPVEISTIFEQDEVVDVIAVTKGHGFEGVTHRWGTKKLPRKTHKGLRKVACIGAWHPSKVMFSVARAGQNGYHHRTELNKKIFRVGSGADDANASTEADATKKSITPMGGFPHYGIVKNDFLLLKGSIPGIKKRVITIRKSLMVHTSRRDLEKIQLKFIDTSSKFGHGSFQTFEEKAAFLGTLKARA

SEQ ID NO: 3047 - protein, 344 aa, Agaricus bisporus
  source: /note="var. bisporus"
  source: /note="strain H97 / ATCC MYA-4626 / FGSC 10389"
MPELPQQQKALFLESKQGDFVVKTRAVPKPGPGQALIQVKAAALNPVDWKIQKYGIYVTDFPAILGTDVSGVIVAIGEGITKFNVGDKVFCQGKIELDYADFQQYALVDEHHLAKIPANINFDQAATMPLGVTTAFLLMYNKPPHGHGLVNPIEAPGHYKDQPFVVLGGSANVGQNAIQFAKLSGFNPIIATASLKHTDFLKSLGATHVLDRNLSVQALKAEIEKITTKPVKHVCDAISVAETQQTGVEILAPGGHLMLVLAPTVSSDDKHILNVVAFRHLEPNVEQITAMYGKLSEWVEKGIIKPNNVEVLPGGLNGIVGGFKRMEANQVSGLKLVVHPEETA

SEQ ID NO: 3048 - protein, 262 aa, Agaricus bisporus
  source: /note="var. bisporus"
  source: /note="strain H97 / ATCC MYA-4626 / FGSC 10389"
MAPGFTISFVNKTIIVTGGNRGIGLAFTRAVAAAGANVAVIYRSAKDAVEVTEKVGKEFGVKTKAYQCDVSNTDIVTKTIQQIDADLGPISGLIANAGVSVVKPATELTHEDFKFVYDVNVFGVFNTCRAVAKLWLQKQQKGSIVVTSSMSSQIINQSSLNGSLTQVFYNSSKAACSNLVKGLAAEWASAGIRVNALSPGYVNTDQTAHMDKKIRDHQASNIPLNRFAQPEEMTGQAILLLSDHATYMTGGEYFIDGGQLIW

SEQ ID NO: 3049 - protein, 614 aa, Agaricus bisporus
  source: /note="var. bisporus"
  source: /note="strain H97 / ATCC MYA-4626 / FGSC 10389"
MSAEDVYEGAVGIDLGTTYSCVGVWQNDRVEIIANDQGNRTTPSYVAFSAEERLIGDAAKNQAAMNPKNTVFDAKRLIGRRYDDPDVKKDMTHWPFQVVEKDGSPLIKVNYLSEEKTFSPQEISAMVLTKMKEISEAKLGKTVQKAVVTVPAYFNDSQRLATKDAGTIAGLDVLRIINEPTAAAIAYGLDRQSKEEKNVLIFDLGGGTFDVSLLNINGGVFAVKATAGDTHLGGEDFDNALLEHFKNEFKKKTKFDISDDARALRRLRSACERAKRTLSSVTQTMVEVDSLYQGEDFSASITRARFEEINAVLFKSTLEPVEKVLKDAKMAREKVDDIVLVGGSTRIPKVQALVSEYFGGRQLNKSINPDEAVAYGAAVQAAVLTGQTSEQTKDLLLLDVAPLSLGVAMQGDVFGVVVPRNTPIPTNKSRVFTTVEDNQTTVTFPVYEGERTQCRDNRLLGEFELTGIPPMPRGQAELVTTFEVDANGLLKVTAQDRTSGRKASISITNSVGRLSSVEIEQMIKDAEQFKQADKDFTARHEAKSDLEAYIHQVESTITSPEIGMKLKRGAKSQVESELARALEKLEIEDSTADELKKAQLGIKRALQKATAGIR

SEQ ID NO: 3050 - protein, 842 aa, Agaricus bisporus
  source: /note="var. bisporus"
  source: /note="strain H97 / ATCC MYA-4626 / FGSC 10389"
MVNFTVDQIRGLMDRSTNIRNMSVIAHVDHGKSTLTDSLVSKAGIIASAKAGDMRFTDTREDEKERGITIKSTAISMYFEVDKEEITSIQQKTEGNEFLINLIDSPGHVDFSSEVTAALRVTDGALVVVDCVEGVCVQTETVLRQALTERIKPVVIINKVDRALLELQVDKESLYQSFQRTIESVNVIISTYHDEALGDVQVYPDKGTVAFGSGLHGWGFTLRQFSNRYAKKFGVDKDKMMVKLWGDNYFNPKTRKWTTNGTDADGKPLERAFNQFVLDPIFRIFDAVMNFKKDATTSMCEKLDIKLAVEERELEGKALLKVIMRKFLPAGDSLLEMIVINLPSPKTAQRYRVETLYEGPMDDESAIGIRDCDPKAPLVLYVSKMVPTSDKGRFYAFGRVFSGTVKAGPKVRIQGPNYLPGKKDDLFVKSIQRTVLMMGRYIEPIEDCPAGNIVGLVGIDQFLLKSGTLTTSETAHNMKVMKFSVSPVVQVAVEVKNAADLPKLVEGLKRLSKSDPCVQAYIAETGEHIVAGAGELHLEICLKDLQDDHAGVPLKISDPVVPYRETVKAESTIVALSKSQNKHNRLFAKALPLDEAVTKGIEDGKVNARDDFKARARVLADEFGWDVTEARKIWCFGPDTTGPNLLVDVTKGVQYLNEIKDSCVAAFQWATKEGVLCEENMRGIRYNILDVTLHTDAIHRGGGQIIPTMRRCCYAAALVASPTLQEPVFLVEIQCPENAIGGIYSVLNKRRGQVFSEEQRPGTPMFTVKAYLPVGESFGFNGELRSHTAGQAFPQSVFDHWEQMNGDPLEKGSKMEELVKSIRVRKGLKPDVPPLDTYYDKL

SEQ ID NO: 3051 - protein, 294 aa, Agaricus bisporus; identical to SEQ ID NO: 604
  source: /note="var. bisporus"
  source: /note="strain H97 / ATCC MYA-4626 / FGSC 10389"

SEQ ID NO: 3052 - protein, 321 aa, Agaricus bisporus
  source: /note="var. bisporus"
  source: /note="strain H97 / ATCC MYA-4626 / FGSC 10389"
MAAMTREVSSQSDIGKMKTEPNGAYKRLEASFRDVIAAGSKFEPEADRYHLYICYACPWATRTLIMRKLKGLESIISVTVVSPRMGSDGWAFANADDYPGAEVDPIHNVKHIKEIYLKISPEYSGRFTVPLLYDKKLDTIVNNESSEIIRMFNSAFNHLLPADKAALDFYPEKLRSDIDEVNSWVYPDINNGVYKAGFAATQEPYTKAVHELFKALDKAEGMLKGRDYLVGNQLTEADVRLWVTTVRFDPVYVGHFKCNISTIRGGYPNINRWMRKLYWNNDAFQSSTNFDHIKTHYYWSHAHINPTRIVPEGPVPVIEPL

SEQ ID NO: 3053 - protein, 538 aa, Agaricus bisporus
  source: /note="var. bisporus"
  source: /note="strain H97 / ATCC MYA-4626 / FGSC 10389"
MHRIALRNSTRRVLAASSKSAVNARSYATAKPAASEVSSILESRISGTAIGGNVEETGRVLSVGDGIGRVWGLKNVQAEEMVEFSSGIRGMCLNLEADNVGVSIFGNDRLIKEGDTVKRTGQIVDVPVGPGLLGRVVNALGDPIDGKGPIEAAERRRASVKAPGILPRRSVNQPMMTGLKPIDAMVPIGRGQRELIIGDRQTGKTAVAIDTILNQKRWNDGNEEVKKLYCVYVAIGQKRSTVAQLVKTLEENDAMKYTIIVAATASEAAPLQYLAPFSGCAMGEWFRDNGKHALIIYDDLSKQAVAYRQMSLLLRRPPGREAYPGDVFYLHSRLLERAAKMSDKFGGGSLTALPIIETQGGDVSAYIPTNVISITDGQIFLEAELFFRGVRPAINVGLSVSRVGSAAQTKIMKKFAGSLKLYLAQYREVAAFAQFGSDLDASTRFLLSRGARLTELLKQGQYQPLATEMQVPIIYAGVNGLLDSIPVDQITKWEAEFREHLTATQSALLSEIATGAVTPELEAKIKKAVEDHVSSFTS

SEQ ID NO: 3054 - protein, 1164 aa, Agaricus bisporus
  source: /note="var. bisporus"
  source: /note="strain H97 / ATCC MYA-4626 / FGSC 10389"
MSLPGLRSSWLRGAARHPIRSLHSSSVSARHAFVPSQSLRAIAAPAVGSYAPKEGEHVLNSPSELARRLSAKVLPKLPRPDVKKVVVVGSGGLSIGQAGEFDYSGSQALKALHEAGVDAVLINPNIATWQTSHQLASEVYFLPVTVDYVAYVLEKERPDGILLTFGGQSALNVGIELDRMGILERLGVKVLGTPIRTLEVSEDRDLFVQALKEIDIPVAQSTAVSTVEDALAAAEEIGYPVILRSAFTLGGLGSGFANNPEELRDLSAKSLSLSPQVLIERSMKGWKELEYEVVRDAADNTIICCNMENFDPLGTHTGDSIVVAPSQTLPDDEYHMLRSAALKVIRHLGVVGECNIQYALNPKSREYCVIEVNARLSRSSALASKATGYPLAYTAAKIALGHTLPELPNAVTKTTTACFEPSLDYIVTKIPKWDLAKFSSQVNREVGSSMKSVGEVMAIGRTFEESLQKAIRQVDPRWKGFEAYVAPEDLDRALSRPTDMRLFAIAYAMYKKDYTVDQVHDLTKIDKWYLYKIDNIVQLHRTLKAAGSIQNVDHELMQRAKRMGFADAQIGDLINATEDAVRAARKSMNITPFVKRIDTLAAEYPAHTNYLYTTYNASEHDVKFDENGTMVLGSGVYRIGSSVEFDWCAVTCARSLRNMGKKTIMINYNPETVSTDFDEADRLYFEELGYERVMDIYELEAAQGAIVSVGGQLPQNIALRLKKSGVNVLGTPPEQIDMAEDRHKFSSVLDSIGVDQPEWSEVTSVVAAKAFANKVSYPVLIRPSYVLSGAAMNVVYAEEELEENLSKAADVSPLHPVVMTKFIDGAQEIDVDAVAYKGKLLVHAVSEHVENAGVHSGDATLVLPPFSLIETDMSRLKTIAEKVAAAFNISGPYNMQIIKKPSENGQEAELKVIECNLRASRSFPFVSKVLGHNFIETATAAITGHEVPEPIDLMAQKRDYTSIKVPQFSWTRLGGADPFLGVEMASTGEVASFGKDIHEAYWASLLSTTGFKVPKVNSGVLIGGDVTKPEMVTIAKLLQGLGFKLYCSSSVVEDYLNNIPFVKAQRIVFPTSDKRKLREVFDEYEIQCVINIARSRGQTFTDEDYVARRNAVDFGLPLLNNAQTALLFVEALAKKIPQGGLRGYAEGRIPPEVRSWSEFVGSRA

SEQ ID NO: 3055 - protein, 1198 aa, Agaricus bisporus
  source: /note="var. bisporus"
  source: /note="strain H97 / ATCC MYA-4626 / FGSC 10389"
MAEQSSATLHPPRLSAMFATSPSAPGTPVHSIQTMRRKAAGHGGPLTKILVANRGEIAIRVFRTAHELAMHTVAIYSYEDRLSAHRQKADEAYQVGKGRTPVAAYLAQDDIIRIALEHGVDMIHPGYGFLSENAEFARKVENAGIAFVGPTPEVIDGLGDKTKARTLAMQCGVPVVPGTPGPVGSYKDGESFIKEYGFPVIIKAAMGGGGRGMRVVREESDFQSSFERAVSEAKSAFGDGTVFIERFLERPRHIEVQLLADSQGNTIHLFERDCSVQRRHQKVVEVAPATHLPEEIRQGILSDAIKLAKSVGYRNAGTAEFLVDQMGRHYFIEINPRIQVEHTITEEITGIDVVAAQIQIAAGATLPQLGLTQDAITKRGFAIQCRITTEDAATGFQPDTGKIEVYRSAGGNGVRLDASSGFAGAQITPHYDSLLVKCTVSGTTYEVARRKMLRALVEFRIRGVKTNIPFLFRLLTHDTFIGGKTWTTFIDDTPDLFKLVQSQNRAQKLLAYLGDLAVNGSSIKGQVGEPGLKTDIVIPKLTNREDPSGPTVDTTFPCTVGWRNIIVEHGPEAFAKAVREYPGVLIMDTTWRDAHQSLLATRLRTTDMVNIAKETSYALANSYSLEMWGGATFDVAMRFLYEDPWDRLRTLRKLVPNIPFQALVRGANGVGYTSYPDNAIYDFSKKAVENGLDIFRVFDSLNYFENMKLGIDAAKKAGGVVEAVVCYSGDVASPKETKYTLQYYLDFIGQLVKEGVHILGVKDMAGLLKPEAAKILIGAIRKAHPDIPIHVHSHDTAGIATASMIAAAAAGADIVDVAIDSMSGLTSQPSMGAVCMALEQTSLGTGIRYDDIQALNLYWSQVRMLYGCFEANVRASDSSVFDHEMPGGQYTNLMFQASQLGLGTQWTEIKQKYIQANELCGNIIKVTPSSKVVGDFAQWMTSNSLSKEQVLERAEQLDFPSSVVEFFQGYLGQPVGGFPEPLRSRVIRDKQRIDGRPGTTLQPLDFKKIKADLRSKFGKHITDTDVTSYVMYPKVFEEYQGFLEKYGDLSVIPTRYFLGRPDVGEEMHISIEAGKTLIIRLMAIGPVVEGRAQRDVWFEVNGEVRAVSIEDKNSAVETVSREKSTSDPGSVGAPMSGVVVEVRVKDGQEIKKGDPVCVLSAMKMESAVTAPVSGHVKRVTVHEGDSINQGDLVAEIVH

SEQ ID NO: 3056 - protein, 366 aa, Agaricus bisporus
  source: /note="var. bisporus"
  source: /note="strain H97 / ATCC MYA-4626 / FGSC 10389"
MKVLAILYDGGEAARQESRLLGTTENGLGIGPWLESLGHEFVSSSKEGANSDFQKHIADAEVLITTPFHPGYLTRDLVEKAKNLRLCITAGVGSDHIDLNAAVDHRIQVLEVSGSNVVSVAEHVVMSILLLVRNFVPAHEMIERGDWQVSDIARNAFDLEGKVVGTIGAGRIGYRVLQRLLPFNCKELIYYDYAPLPEAASKAVNTRKVDDLKEFVSQCDVVTLLKSFKKGAWLVNTARGAICDKDAVAAAVKSGQLNGYAGDVWNVQPAPKDHIWRTVKNPLNGGNGMVPHYSGTTLDAQARYANGTKSILEHYFNNTEQEAQNIIIGLGKYETKACLQWEKKVKWRRTKDVKDYTSPIGFLITS

SEQ ID NO: 3057 - protein, 402 aa, Agaricus bisporus
  source: /note="var. bisporus"
  source: /note="strain H97 / ATCC MYA-4626 / FGSC 10389"
MSLVKRVPNAREFYPMCEPEIGTKNETPILFKPLTIRGVTFRNRIWLSPMCQYSSDDGHATDHHLVHLGSYATHGVGAIVIEATAVVPEGRISPEDSGLWKDSQIAPLKRIVDFAHAHGAKIGIQIGHAGRKASTVSPFVTKPDGKHALTSEEAGWPDQVYAASAIPFVPEVYPDPQEATEEYIKTVIDAFVAAAKRAEKAGFDFIEIHAAHGYFLNTFLSPLSNTRTDKYGGSLENRMRLTIEVAQRLREAWPADKPLFIRITAVDWAEGPEKDESGKWLQWGIEQSIVLAKRLQEVGVDLVDVSSGGLWAAQKITVGPGYQSGFAAQIKKAVPNLLISAVGAITEPEQAETYLKEGRADVITMARELLRNPSWPLYASKKLGVEIQPSNQQAAGWFRYRI

SEQ ID NO: 3058 - protein, 654 aa, Agaricus bisporus
  source: /note="var. bisporus"
  source: /note="strain H97 / ATCC MYA-4626 / FGSC 10389"
MSSSKAIGIDLGTTYSCVGVWQNDRVEIIANDQGNRTTPSYVSFSDNERLIGDAAKNQVAMNPHNTVFDAKRLIGRKFDDQEVQSDMKHFPFEVFSRTGKPYIRVEYRGEKKEFSPEEISSMVLSKMKETAEAYLGTTVNNAVVTVPAYFNDSQRQATKDAGVISGMNVLRIINEPTAAAIAYGLDKKVSGERNVLIFDLGGGTFDVSLLTIEEGIFEVKATAGDTHLGGEDFDNRLVTHFIQEFKRKNKKDLSGNQRAVRRLRTACERAKRTLSSAAQTSIEIDSLFEGIDFYTSLTRARFEELCQDLFRGTLEPVEKVLRDSKIDKSNVHDIVLVGGSTRIPRIVKLVSDFFNGKEPNKSINPDEAVAYGAAVQAAILSGDTSEKTQDLLLLDVAPLSLGIETAGGVMTALIKRNTTVPTKKSEIFSTYSDNQPGVLIQVYEGERARTKDNNLLGKFELSGIPPAPRGVPQIEVTFDIDANGILNVSASDKTTGKSNRITITNDKGRLSKEEIERMVDEAEKYKAEDEAAASRIQSKNGLESYAYNLRNSITDEKLADKFDAADKSKLETAINETISWLDNSQEASKEEYDDKQKELEAIANPIMQKLYSAAGGAPGGFPGAGGAPGGAPGGAPGGFPGAGGEEGPSVEEVD

SEQ ID NO: 3059 - protein, 699 aa, Agaricus bisporus
  source: /note="var. bisporus"
  source: /note="strain H97 / ATCC MYA-4626 / FGSC 10389"
MCGIFGYCNYLKEKRREEVLEILCAGLARQEYRGYDSAGLVIDGDKPGSVEYFKEVGKVAGLRKKIAGSQLDVEKSYIAQVSIAHTRWATHGPPSERNCHPVRSDQNSEFVIVHNGIVTNSAELRQVLQKRGYQFKTDTDTEAVAILTKYIFDSQGSARRLTFTEIVKAVLKELEGSFAFVFKSSHFPNEVVTARRGSPLLIGVKTDKKLKVDFVDVEFAGQDPKETLPESIQANSLTGLAVPSANPKVFRTQSRTFITEDGFPQPIEFFIASDAAAIIEHTKRVLYLEDDDIAHIADGELQIHRLRRKEEGHQTPSQIATTRTIETLELEIAAIMKGKFDTFMQKEIYEQPESVVNTMRGRVNFDEQRITLGGLRAYLPIMRRSRRIVFIACGTSYHSCLATRAIFEELTEIPVGVELASDFLDRKTPIFRDDVCVFLSQSGETADTILAMRYCMDRGALCVGVVNTVGSTISRETHCGVHINAGPEVGVASTKAYTSQYVALMMIALQLSEDRISFTERRNQIINGLHSLSAQITKVLELDPILEELAEGIHKNKSLLIMGRGMQHATCLEGALKIKEISYMHSEGILAGELKHGPLALIDENMPVIIIMTRDSLYPKVQSAFAQITARKARPIVLCNEGDDGIPANATTIRVPQTVDSLQGLLNIIPLQLLSYHLAVKNGCDVDFPRNLAKSVTVE

SEQ ID NO: 3060 - protein, 265 aa, Agaricus bisporus
  source: /note="var. bisporus"
  source: /note="strain H97 / ATCC MYA-4626 / FGSC 10389"
MSAQISKKRKFVADGVFRAELNEFFTRELAEEGYSGCDVRVTHARTEIIIRATHTQEVLGEKGRRIRELTALVQKRFKFPENSLELYAEKVQYRGLSAIAQCESLRYKLLGGLAVRRACYGVLRFVMESGAKGCEVVVSGKLRAARAKSMKFTDGFMIHSGQPVREFVDYAVRHVLLKQGVLGIKVKIMKGHDPEGQLGPKKPLPDAVQIYEPPVDKVVLEPSSEQREPVPVPVAAPAAEEPYVPPQDEAFQQQEAYGAEQQTVF

SEQ ID NO: 3061 - protein, 444 aa, Agaricus bisporus
  source: /note="var. bisporus"
  source: /note="strain H97 / ATCC MYA-4626 / FGSC 10389"
MSITKIHARQIFDSRGNPTVEVDLHTAKGRFRAAVPSGASTGVHEAVELRDGNKNEYLGKGVSKAVENVNQIIAPKLIESGLKVTQQKDIDDWLIKLDGTPNKGKLGANAILGVSIAAAEAGAAEKSVPLYQHFAELSGVKPPYILPCPAFNVINGGSHAGNKLAFQEFMLLPTGAQSFTEAMKIGTETYHTLKKVISAKYGIDAVNVGDEGGFAPNVSGADEALELLSEAIKKAGYEGKIKIALDVASSEFYKDGKYDLDFKNANSDPAKWISGVELADLYLSYVKKYPIVSIEDPFDQDDWEAWTHFTSKSGIQIVGDDLTVTNPLRIKTAIEKKACNGLLLKINQIGTISESIQAAQLSQSDGWGVMVSHRSGETENTVIADLVVALGLGQIKTGAPARSERVAKYNALLRIEEELAGSGAYFAGDKGLATGTTPPQLLQK

SEQ ID NO: 3062 - protein, 502 aa, Agaricus bisporus
  source: /note="var. bisporus"
  source: /note="strain H97 / ATCC MYA-4626 / FGSC 10389"
MPKTYTHTFNEPTFKGTSHINTGLFINNQWVDPVEGGTLDVINPTTGKVITSVAAGSAKDVDIAVEAATKAYKTSWGLKLPGSERGRLMNKLADLMEKHSEEFVALEMLNVGKTYGPAKTFDVAQSIYTIRYYAGWADKIHGKTIETRDTKMAYTRHEPYGVVGCIVPWNFPLLMTVWKLGPALSTGNAVILKPSEMTPLSALRLADLFVEAGFPPGVFNIINGYGNKVGQAIAEHMKISKVAFTGSTLTGRKILKAASETNLKKVTLELGGKSPTIIFNDVDLEQALKWASAGIFINMGQSCVAASRIFVQEGIYDKFLQEFTKIAKTLTENTGSPFIPTTQHGPQISQIQFDRVMGFINSGKQEGAKVQIGGERHGTEGYFIKPTIFTDVTPQMSIMQDEIFGPVCSVVKFKTEEEVLSIANDVAYGLGANVFTENTATAMRMAHALEAGSIWVNCAQQTEMNVPFGGFKQSGMGRELGQYALDSYTQVKAVHINLGQKL

SEQ ID NO: 3063 - protein, 253 aa, Agaricus bisporus
  source: /note="var. bisporus"
  source: /note="strain H97 / ATCC MYA-4626 / FGSC 10389"
MGRVIRTQRRSHAIFKAHTHLNKAPARFRALDFAERNGYIRGVVKEIIHDAGRGAPLARVVFRDPYRYKLRKETFIATEGLHTGAFVYCGKKAALTVGNVLPVSQCPEGTIICNVEEKVGDRGALARTSGNYATIIGHSDDNKTRIRLPSGSKKTVSGSARATIGIVAGGGRIDKPLLKAGRAYHKYKAKRYNWPRTRGVAMNPVDHPHGGGNHQHIGHASTVARSSVPGQKVGLIAARRTGLLRGTVKVKEV

SEQ ID NO: 3064 - protein, 410 aa, Agaricus bisporus
  source: /note="var. bisporus"
  source: /note="strain H97 / ATCC MYA-4626 / FGSC 10389"
MSAETWQQVPLAPPDSIFKLTAAYKADSFEKKVNLGVGAYRDDRSKPWVLPVVKKATKILLEDETLDHEYLPILGLPEYTAAAAKLILGPGSVAIKDKRVVSAQTISGTGANHLGALFLSRFYGFNGDKRIYLSNPTWANHQAIFRNVGIEPVDYPYYDPKTIGLDFDGFIDALKTAPTRSVFLLHACAHNPTGVDPTSEQWEAIAEVMLERKHFAFFDCAYQGFASGDLDRDAFAVRYFVDRGVAMLVCQSFAKNAGLYGERVGALHVVSQDSETADRVKSQLSVLQRSEISNPPTHGARLITLILSDAGLFEEWKRDISTMANRIIAMRQELYRLLTEKLGTPGNWDHIINQIGMFSFTGISPAQSQALVEKAHVYLTGNGRISMAGLNSNNIEYFAESLDKVVRGTL

SEQ ID NO: 3065 - protein, 460 aa, Agaricus bisporus
  source: /note="var. bisporus"
  source: /note="strain H97 / ATCC MYA-4626 / FGSC 10389"
MGKEKTHVNVVVIGHVDSGKSTTTGHLIYKCGGIDKRTIEKFEKEAAELGKGSFKYAWVLDKLKAERERGITIDIALWKFETPKFMVTVIDAPGHRDFIKNMITGTSQADCAILIIAGGTGEFEAGISKDGQTREHALLAFTLGVRQLIVAVNKMDTTKWSEDRFNEIIKETSTFIKKVGYNPKTVAFVPISGWHGDNMLEESANMPWYKGWTKETKGGVTKGKTLLDAIDAIEPPVRPSDKPLRLPLQDVYKIGGIGTVPVGRVETGIIKAGMVVTFAPSNVTTEVKSVEMHHEQLEQGSPGDNVGFNVKNVSVKDIRRGNVASDSKNDPAKEAASFNAQVIVLNHPGQIGAGYAPVLDCHTAHIACKFAELKEKIDRRTGKSLEDNPKFVKSGDAAIVKLIPSKPMCVESYNEYPPLGRFAVRDMRQTVAVGIIKSVDKTDKSGGKVTKSAEKAAKKK

SEQ ID NO: 3066 - protein, 552 aa, Agaricus bisporus
  source: /note="var. bisporus"
  source: /note="strain H97 / ATCC MYA-4626 / FGSC 10389"
MTGSLASNYASWKQLQEIYDKDRAKIVLRDLFAADPQRFSKLSATYNSQSGPGVQILLDYSKHLVTEPILQKLFNLLREAKVEDARDKMFSGEHINTSEDRAVLHVALRNFNDFSIKEEGVDEVSKVLQHMKEFSESVRSGQWKGYTGKTINTIVNIGIGGSDLGPVMVTEALKPFSKRDLNAHFVSNIDGTHIAETLRLCDPERTLFIVASKTFTTQETITNAESARDWFLGFAKDKAHVAKHFVALSTNTSAVTAFGISEANMFQFWDWVGGRYSLWSAIGLSIALVIGFDNFEKLLRGAHAMDQHFKTTPLEKNLPAIMAALGIWYNDFYGAQTLALLPYDQYLHKFADYFQQGDMESNGKFITKNGDRVNYQTGPIIWGASGTNGQHSFYQLIHQGTKIIPADFMAPATSHNPIANSKHHRILLSNFFAQPEALAFGKTEEEVRKELGQNASEALVKSKVFEGNRPSSSLMFDKLDPATLGALIALYEHKIFVQGVVWGINSFDQMGVELGKVLAKQILAQLDKSDDVKGHDSSTTGLIHWYQAHRKE

SEQ ID NO: 3067 - protein, 579 aa, Agaricus bisporus
  source: /note="var. bisporus"
  source: /note="strain H97 / ATCC MYA-4626 / FGSC 10389"
MAQVIVVGGGLAGLSAAHTVLERGGNVLVLDKQPFMGGNSTKATSGINGAGTQPQQDAGIADSARIFFEDTKKSARELARDDLIQVLTGRSADAVHWLQSKFGLDLTKVARLGGHSQPRTHRGGAQFPGMVITYAQLERLEDLSVSDPERVKVIKKARVTKLVKDSSGAVVGVEYECGGKTETAYGPVILATGGYAADFTGDSLLKKYRPEYYELPTTNGEHSTGDGHKLALSIGASAIDLEKVQVHPTGLVDPKEPDAKVKFLAAEALRGVGGLLLDNTGKRFVDELQHRDYVTGKMWENGKYPIRLVLNGKASKDIEWHCKHYVGRGLMKRFDSGEALAKEFGLAPEVLRKTFEDYNVSVRTQKDPFGKKFFQGEWKFDDFFHVAVMTPVLHYTMGGLEIDAESRIIDQSGKPIPGLFAAGEVAGGVHGANRLGGSSLLGCVVFGRVSGDSASAYLLQATSAAVQKAGGRLGALAGHISGSTAASTPDSAAAAPVGKSASGEYTLADVAKHNKKDDIWVVIDGQVLDVTKFLPDHPGGEKAIILYAGRDATEEFNMLHDPKVIPRYAPDAVIGKVKA

SEQ ID NO: 3068 - protein, 895 aa, Agaricus bisporus
  source: /note="var. bisporus"
  source: /note="strain H97 / ATCC MYA-4626 / FGSC 10389"
MATLTTPGAPDEYRLPTNVKPAHYDVTIKTDLENLSFEGFVRIELDVKEPTSRIVLNTSGLDLGQATLYSDSLKKELAPSEQTLDTASERVAYSVNDTLPAGSKAFLKVSFKGELTGSMMGYYKSTYEEDGKPKYYALTQFEPTAARRAFPCWDEPLLKATFGITLISRADTTNLSNMPAISEEAVTPNTDFGGDASLFSGLKDGQWKVTKFQTTPPMSSYIVAFANGYFKYLEDSVVLPLSGKTLPLRIYTTAEYIHQAQFALDIKKAVLPIYEKIFDVGYPLPKLDTLVASDFDAGAMENWGLITGRTNAFLLDPKKADLQAKKQIAATQSHEVAHMWFGNITTMEWWNYLYLNEGFATLMGEVIIAGEVFPEWKVDSNFISEHLNRALGLDAKPSSHPIEVDCPDANHINQIFDSLSYSKAASVLRMLSNYVGEDRFLKGVSIYLKNKLYGNSVTNDLWEGISQATGIDVPKIMDTWIKKIGFPVITVTETPEGIRVRQDRFLETGKGEGADNETIWNVPLRILSIDSNGKPVLDNSALLTEREQTFKIDSSKPFKLNTGTSGVYRVLYEPKTLAKIGEEAAKDGSVFSLNDRLGLVYDSVALSKAGLAQVSSALTLMDILGKTEKEYLVWSGIADNLSALVSTWWENQDVVDQLNAVRGALFVPLVKKLGFDYSSSDSVDTTLLRTLAVSQAAAAGDPSVIKELQSRFEHFMKTGDDSRIPADLQRATFSTVVRRGGRAEYNAIVGIYDKPSTPTARVAAIVAMGATHDVKLLQETYSFIKNKSRDQDIVYFFRGLSDNIKMRRGMVAYFENEYDTLIERFGGNFTLQYLVTLSFSFLSTNEDLKKTEEFFKGRDTSKYSMALAQSLDSIRARVQFIERSTSDLEKWLKER

SEQ ID NO: 3069 - protein, 1199 aa, Agaricus bisporus
  source: /note="var. bisporus"
  source: /note="strain H97 / ATCC MYA-4626 / FGSC 10389"
MYGLSNRTSAWRALRSHVIPFTSASRLNSTKPPRSAWQQALTPSSPVLVQENFPKHFIFALDIGRRFLKYSIFGLTILAVSAGGAYEAAHMFVEKNGLAPESDEEVKRWQWESDADKWTGDSVNGGTDPNLGFKVRHLVRAAWMAYTWGIGYTTAAIGSSDQRGSGLVGPMGIKVINPRLQLTEDFLREAIRVAESSQDGRHSHTLAHLWTLHASILEKLGDDFLPEAKAELERAAASLDGDKRLNSARLALKLGDIDARLGLKEQALERWTRTLALLNDKQPEVASIAGELVPERPPSSPLAQRLLSSTLVSLSAFYARTGQYREAQLVEERALSVLRAIHPPDSLATASPPQALHALFLLQRSSVISVHLAEVAFAQRRPAVFSMQWLTSAAESSERVARVLTGLPLVKSQDFHSKSDLPHPLEERLLTSYSSSRSMKGVAEGLLRDARRTAAESWNLMGALHEKKEGARSRSALACYERAVEWAGCPSSDGDNGREAAQGIPDADWKMVWSNYQRMKLQVEGRCSYRGVVLNLSFIDTRFLADRSTPLCSLEVAKSFALLSSNEKKYTHYLNQASWAGARIIQGQWTPHAIELYDLLILIFSSSDKFKLADLEALRVASKVNTEDWENLLQYTIQVLSNLVNFKSFGFTKIIPRVNSEIFEAVVLNSANKEQAASLWNKLKDHIYSTTPEASLYIGKRSLGHVSNYYVGEVINDEEVTAIQAAAEKLNIDVLNTRVAKKGPGDYVLLIASANTGPSATHEIDVQGKTAQLRVEYAAHNTRFETGSIQDHKDASKEWVKDVGPVVESYIGFIETYVDPYGGRAEWEGFTAIVNKELSAKYEILVNKAPELIKVLPWGKNFEVDIFRKPDFTALEVVNFATGGIPAGINIPNYYDIRASTGFKNVSLANILAAKSPNEKLTFIHPDDVDLYNSWDNRSFELQVANHELLGHGSGKLFEEYADGTKNFVPEQVINPLTGKPITSWYKPGQTPGSVLGEVSSSMEECRAETVALYLVGERDILEIFGYTDSQDIENIQYITFLLMARAGLRGLEFYDPVNKKHGQAHMQARLGITQHLIRSGIARLEEVRDANGALVDLYVRVDKNLVLTKGREVAGKLLIELQVRKSTADGAGAREYYNNLTNPIAGWEGEIRDLVLAKKQPRKVFVQPNTHLVNGNVELKEYAFTPAGVIESFIERNL

SEQ ID NO: 3070 - protein, 312 aa, Agaricus bisporus
  source: /note="var. bisporus"
  source: /note="strain H97 / ATCC MYA-4626 / FGSC 10389"
MGATRADKQVYFEKLKELLYAYPSVFIVNVDNVGSNQMHQIRVALRGKGVVLMGKNTMVRRALRTLIPESPQFERLLPHVRGNVGFVFTKSDLKEIRDIIVANKVAAPARAGAFAPKDVIVPAGNTGMEPGKTSFFQALGIPTKIARGTIEIVSDVKVVTALTRVGPSEATLLNMLNISPFTYGMTVNQIYDSGNIFSPEVLDIGEDELVNRFLTGIKTIASISLALNYPTVVSVAHSLVNAYKNLVAVSLATEYTFEGAAKIKEYLENPDAFAAVAAAAAPAAAAEAPKEEEKKEEEEEASDDDMGFGLFD

SEQ ID NO: 3071 - protein, 310 aa, Agaricus bisporus
  source: /note="var. bisporus"
  source: /note="strain H97 / ATCC MYA-4626 / FGSC 10389"
MPFVKKVKSDAYFSRFQVKYRRRREGKTDYSQDYARKRLVTQAKNKYNAPKYRLVVRFTNKDIIVQIVYARLQGDFVLTSARSAELPRYGIKHGLTNWAAAYATGLLAARRALTKLSLADQYEGVAEPDGTLSITEAIEEEDAPRPFKAFLDVGLKRTSTGSRVFGALKGASDGGIYIPHNEKRFPGYDPESKELDAEVLKKYIFGGHVAEYMESLEEEDDERFKKQFSKYLADGVGSEDIEEIYTNAHAAIRENPEFKPSEKTKDWKAECLKFKAKRFTLEERRARIAEKIEKFKAGGLEEEDAGEDDD

SEQ ID NO: 3072 - protein, 338 aa, Agaricus bisporus
  source: /note="var. bisporus"
  source: /note="strain H97 / ATCC MYA-4626 / FGSC 10389"
MVKVGINGFGRIGRIVLRNALQFQDIEVVAVNDPFIDLEYMAYMFKYDSVHGRFKGTVEVKNGSLVVDGRPMKVFAERDPAAIPWGSVGADYVVESTGVFTTIDKASAHLKGGAKKVVISAPSADAPMYVCGVNLDKYNPKDTIISNASCTTNCLATLAKVIHDNFGIVEGLMTTVHATTATQKTVDGPSHKDWRGGRGVGNNIIPSSTGAAKAVGKVIPSLNGKLTGLSMRVPTQDVSVVDLVVRLEKPASYEQIKEVMRKAAEGEYKGIIAYTDEDVVSTDFISDNNSCVFDAKAGIQLSPNFVKLIAWYDNEWGYSRRVCNLLQYVAKEDAKAGI

SEQ ID NO: 3073 - protein, 375 aa, Agaricus bisporus
  source: /note="var. bisporus"
  source: /note="strain H97 / ATCC MYA-4626 / FGSC 10389"
MEEEVAALVIDNGSGMCKAGCACDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAFYVAIQAVLSLYASGRTTGIVLDSGDGVTHTVPIYEGFALPHAILRLDLAGRDLTDFLIKNLMERGYPFTTTAEREIVRDIKEKLCYVALDFEQELQTAAQSSALEKSYELPDGQVITIGNERFRAPEALFQPAFLGLEAAGIHETTYNSIFKCDLDIRRDLYGNVVLSGGTTMFPGIADRMQKELTSLSPSSMKVKIVAPPERKYSVWIGGSILASLSTFQNLWCSKQEYDESGPGIVHRKCF

SEQ ID NO: 3074 - protein, 457 aa, Agaricus bisporus
  source: /note="var. bisporus"
  source: /note="strain H97 / ATCC MYA-4626 / FGSC 10389"
MVLPHEPEFEQALHELETSLQPFLTTNPQYKKALEIIQVPERVLQFRVTWEDDQGKPQVNRGFRVQYNSALGPYKGGLRLHPTVNLSILKFLGFEQTFKNALTGLSMGGGKGGSDFDPKGKSDNEIRRFCVAFMSELFRHIGQDTDVPAGDIGTGAREIGFLFGAYRRLKNEFTGMLTGKGINWGGSFIRPEATGYGLIYYVEHMIAHACPEYSLDRPSTLVAISGSGNVSQFTALKVIELGATVLSLSDSKGSLISEKGYTKEAIEKIAELKLKGGALEAIVDDLGAGYTYHAGKRPWTLLPQVHIALPGATQNEVSQEEAEALVKAGTRIVAEGSNMGCTEEAIAIFENSRRASRAGVWYAPGKASNCGGVAVSGLEMAQNSQRLAWSTQEVDAKLKSIMAECYQICYTAGSRWSGEKVAEGVAEGEALPSLLSGANVAGFIKVADAMKEQGDWW

SEQ ID NO: 3075 - protein, 474 aa, Agaricus bisporus
  source: /note="var. bisporus"
  source: /note="strain H97 / ATCC MYA-4626 / FGSC 10389"
MSQLRVSGTKIVNEAGSETVLRGAGLGGWMNMENFISGYPGCEYQIREALTDTIGQEKADLFFDKFLEYFFQEQDAKFFQSLGLNCIRIAFNYRHFEDDMNPMVLKESGFKHLDRVIDICAQHGIYTILDLHVAPGGQNTDWHSDHGGHIANFWNHRHFQDRALWLWTELAKHYKGNKWIAGYNPLNEPTDSKHTRVIKFYDEVHAAIRAQDPDHIIFFDGNTFASDFSHFGDSHKNWDNTAYSIHDYSVFGFPAAPENYTGTPEQQRRLRRSYEKKREWMDERGLCVWNGEWGPVYARKQYDGAATDSINEGRYKVLSDQLDIYTKDRLSWSIWLYKDIGFQGMVHTSLDTPYMQLFKDFLAKKHRLATDAWGADDSAVRSAYQPLIELITKEVGDQYRQIYPAPVWKFTDRVGRLSRNILVAEFLVKEWADHFVGKSEAEIDAIAASFKFENCLKRDGLNAILTANAKLVKQ

SEQ ID NO: 3076 - protein, 1029 aa, Agaricus bisporus
  source: /note="var. bisporus"
  source: /note="strain H97 / ATCC MYA-4626 / FGSC 10389"
MSTPEPAYVARLGLNSKTPLNLVKNMPGYTTPVFKGKEEQRALVEEEVASKGFIPRELVAGEVNWFYSNLGIDDTYFQNESHEVISDHILALFGAKIMAYTKHDPSTLVIDLERIDERGNSATFIHSSAPGLTSTEGPGATCEARIDELFLDPSTPEKAYRLETFRSAGSISATASQQLRCYFVTKCDFPKTKAEIVPGQTEIRSVSDSNFLERATKNTLDIYQKVMSNVETRHGPVIEVYEVEGTRKRRLVIGYKMGATSRFFSALSNLYHFYSLYSTGKYVEQFANGITIISIYLNPLPNSSAPPIENSIYQVMKEASLLFCLPDNPFFLPKSAESHAVQEATYAYCGWVFAQHFCNRLGPAYLQLKNVLNESDPTHAEVLNNIKRRFREETFTRESIAQAIHAYPNLIRLLYVNFAMSHYPQSAEASKLGPTLSYQRLQTVQPLSDEELYDKIRRSVPNKQELQVLESFLIFNKHVLKTNFYQSTKVALSFRLTPEFLPEVEYPKTPFGVFFVIGNEFRGFHIRFRDVARGGIRLVMSRNRENYSINQRMLFDENYNLASTQSLKNKDIPEGGAKGTILPSLGAHPRRCFEKYVDAIIDLLIPGQTPGIKEPLVDLFGKPEILFFGPDEGTAEMMDWAALHARDRGAETWWKSFTTGKTAATLGGVPHDTYGMTSRSIRQYVLGIYSKLGLREKDITKVQTGGPDGDLGSNEILLSSDKTVAIIDGSGVLHDPVGINRAELIKLAKARLTVGHFDVSKLSENGYLVKVEQHDVKLPSGEIVLDGTDFRNTAHLRFKADLFVPCGGRPESVNISNMNALIDEDGKPYFKYVVEGANLFFTQQARLHLEKRKVVLFKDSSTNKGGVTSSSLEVLAGLALSTEEYTNLMIFKDGKPSTFYQNYVKDIQAIIVDNAAAEFQCLWKEHTRLGETKPRTQISDELSSTLNSLQAELEGSDLFDDEPSRRGVMRRAIPKTLVDEIGLDTLLKRLPDAYQRALFSSYVAAHFIYKYGVNASSVDFFHFAKDLAK

SEQ ID NO: 3077 - protein, 200 aa, Agaricus bisporus
  source: /note="var. bisporus"
  source: /note="strain H97 / ATCC MYA-4626 / FGSC 10389"
MATFSSTPIVIDGKGHLLGRLASIISKQILSGQKIVVVRCEEINVSGSFFRNKLRYHNFLHKRHIVNPKKSGPFHHRAPSKILYRAIRGMVPHKTPRGAAALERLKLFEGVPPPYDKKKRMVVPEALRVLRLKPGRKYCTVKRLSHEVGWGYKDVVDRLEDKRKLKAQAFHERKVAALKLRQKAVSDATPSFQQLAQLGY

SEQ ID NO: 3078 - protein, 250 aa, Agaricus bisporus
  source: /note="var. bisporus"
  source: /note="strain H97 / ATCC MYA-4626 / FGSC 10389"
MAPSTTVPSASAIEVPETLLKKRKQNEKAREERLAAAAAARKAQKAKRKVIFKRAESYVKEYLSKEKEEIRLKRAARASGDFYVPAQPKVYFVIRIRGINEIAPKPRKILQLLRLLQINNGIFVKVTRATQQMLRLIEPYVAYGEPNLKSIRELIYKRGYGKVNKQRIPLTNNGVIEESLGKFDILCVEDLVHEIATAGPNFKQASNFLWPFKLSNPTGGWRTRKFKHYVQGGDFGDRETSINKLIRQMN

SEQ ID NO: 3079 - protein, 371 aa, Agaricus bisporus
  source: /note="var. bisporus"
  source: /note="strain H97 / ATCC MYA-4626 / FGSC 10389"
MASRPTVSVHSSTGEASSSLPLPAVLTAPIRLDVVQQVHKSIAKNRRQAYAVAENAGHQTSAESWGTGRAVARIPRVGGGGTHRSGQAAFGNMCRGGRMFAPTKTWRRWHVRVNQNQRRFAVVSALAASALPSLVLARGHRIEEIQEVPLVIAADAESFTKTKEAVALLKTLKAYSDVVKVSNSRKLRAGVGKLRNRRHRQRRGPLVVYNEDKGIVKAFRNIPGVELINVRRLNLLQLAPGGHLGRFVIWTEGAFKALDDVFGTFDKASSYKKDYLLPTAKISNPDVTRLINSDEIQSVVRPANPKISKRPWTQKKNPLVNKAILFRLNPYAKTLRRQEILKQERLKKKNAKKPKQPKAAGKQFLDNLFAL

SEQ ID NO: 3080 - protein, 393 aa, Agaricus bisporus
  source: /note="var. bisporus"
  source: /note="strain H97 / ATCC MYA-4626 / FGSC 10389"
MATAATAGVIVPHLKTLADLSPAQIVGILARAHTLKKHGAAYLSPIGWPPREFISHRRPGPTLRNKSIALLFSKRSTRTRLAAETSATFLGGNAIFLGRDDIQLGVNESLRDSARVIGGMCAGIFARVDDHSEIEELAKYSPVPVLNALSSLWHPTQVLADLLTLHEKHRLFEKPLELARETPGIPPLSPLTVAYVGDSANVLHDMLVTYPRMGHKLRIASPEKYRAPSEVWDRVVQLGCDKDIVWTADPKEAVHNADVVVTDTWISMGQEAEKEERLQAFQGYQVTEALCKEGGAKENWKFLHCLPRKSHEVDDEVFYGPRSLVFDAADNRMWTIMALFDLLFARWSLSPERITAIQQAHNARTTTMQGKGQKSPLKPLIDILAVKTPNPSE

SEQ ID NO: 3081 - protein, 416 aa, Agaricus bisporus
  source: /note="var. bisporus"
  source: /note="strain H97 / ATCC MYA-4626 / FGSC 10389"
MAPIGSLYTVDAQSKGKMIRSVVALAGQEVELLPFEFGVTNKSSEFLSKFPLGKIPAYQHSNGFKLYEGNAIARYLAGLYPNTGLLGGTPEEAALVDQWMHVVETEADTYDTWISFLVRGLVPYNKPIELNFYERLERCLAVLESHISTRTFFVGERITLADLSVASVLSKAVAQTVDASRRPKYPNLMRHLDTIANQPKLKAVFGQVNYIDKAIQYTPPAKEKKEKAPAPPKAEKKPKQEEADEEEEPAVPAEPKVKNPLDDLPKSTFNLEDWKRAYSNKDTRGADGAIEWFYQNFDSTGFSVWRVDFKYNEELTLTFMSSNQITGYFNRLEASRKYLFGSVGVLGENNNSIISGTLILRGQDAEPVVNVAPDWESYEYKKLDLSKEEDKQFFEAALAWDLEVSGKKWADGKNFK

SEQ ID NO: 3082 - protein, 504 aa, Agaricus bisporus
  source: /note="var. bisporus"
  source: /note="strain H97 / ATCC MYA-4626 / FGSC 10389"
MSSSLMPRSDSYNARVRGASHIDFKTATTGVAAKAMRNELSGIVSTISDPPSRKAFDTEMQSFFYLFTRYLAERAKAVDLDWDCIKSPADDKIVPYAQLPKPKDVSNLNKLAVLKVNGGLGTSMGMTGAKSALEVKDDMTFLDLTVRQIEHLNTSSRVDVPLILMTSFNTHEDTLRIIKKYANQQLRITTFNQSRYPRIYKESLLPCPQRADDDKKHWYPPGHGDLYNALLHSGVLDQLLSEGKEYLFVSNSDNLGAVVDESILQHMIDTQAEFIMEVTDKTKADIKGGTLIDYEGSIRLLEIAQVPSEHVEDFKSVRKFKIFNTNNLWINLKALKRIMEVEGMELDIIINPKTTDDGHAVIQLETAAGAAIKHFKNAHGINVPRKRFLPVKSCSDLLLIKSDIYSLSHGQLVINENRMFETTPVIKLGDHFKKIQQFQRRFKKIPRIIELDHLTVTGDVYFGRNVTLRGTVIIVANEGQRIDIPDGCILENRLLSGNLSMIEL

SEQ ID NO: 3083 - protein, 546 aa, Agaricus bisporus
  source: /note="var. bisporus"
  source: /note="strain H97 / ATCC MYA-4626 / FGSC 10389"
MATAQLATFKIPPVSNEPMLSYAPGSPERAGLQAALAEMQSQLPFEVPCIINGQEVRTNNIQKQPMPHDHARHLCTFHEGSPELVEKAIAGALQAKDAWETMPWNDRAAIFLKAADLASGKYRYKLMAATMLGQGKNTWQAEIDAAAELADFFRFGVSYVEELYAQQPPKNAPGCWNRTEYRPLEGFVLAVSPFNFTAIGGNLPGSPALVGNVVVWKPAPAATYSNYLVFKILAEAGVPPGVIQFIPGGAEIVQAAIQSPNFASLHFTGSTNVFKSLWKDISSNLDKYKVYPRIVGETGGKNWHVIHKSAEVRNAVLQSVRGAFEYQGQKCSALSRLYVSRSVWENGFKTQYLEEIAKIKVGPCLDWNNYMGPVIGRRAYDNITGFIKKAKEEGGEVLIGGSGDDSKGFFIQPTVILTKDPRSTTMVGEIFGPVVTAYVFEDSDYEKTLELIDTTSIYGLTGAIFASERQALLTATNRLRNAAGNIYYNEKCTGAVVGQQPFGGARGSGTNDKAGSISIFYRFVSARSIKENFVGLEDFHYPSNLV

SEQ ID NO: 3084 - protein, 546 aa, Agaricus bisporus
  source: /note="var. bisporus"
  source: /note="strain H97 / ATCC MYA-4626 / FGSC 10389"
MKILHSTSLSSSTIMYPVDGIRSQIEWNTTLNVSDAPVPTETTKYHRKTAIIATIGPKINTVEKLTELRHAGVNIVRMNFSHGTHEYHQSVIDNTRQMIKNDPHGRPVAIALDTKGPEIRTGQTRDGNDYPIKAGDEFIVTTDPKYSDICDNKVLFVDYANLASVTAPGKLIYIDDGIISLLILSIDGMNLHVRALNNGTLSSRKGVNLPKTDVDLPPLSEKDKDDLRFGIRNGVDMIFASFIRRGEDVRQIREVLGPDGASIKIIVKIENEQGVANFDEILKEADGVMVARGDLGIEIPASQVFLAQKMMIAKCNIVGKPVIVATQMLESMTYNPRPTRAEVSDVANAVLDGSDCVMLSGETAKGSYPVQSVLMMAETCLLAETAICYPPLYDDLRAVQARPTETAETVAIAAVAAAAEQDAKALLVLSTSGETARLVSKYRPKIPIITVTRNEQTARQIHLHRGCYPFWYPEPRGVQNHQWQTDVDNRIRFGLRNALALNVIQPGASIIAVQGWKGGLGHTNTLRILTVPTDPADLELQPLGSL

SEQ ID NO: 3085 - protein, 576 aa, Agaricus bisporus
  source: /note="var. bisporus"
  source: /note="strain H97 / ATCC MYA-4626 / FGSC 10389"
MSDPISLIPIVGIPGEVKNRLDILDFVKDEKFFTLYVRALKILQDRDQSDYSSFFQLGAIHGVPHTEWAKARPQLNPFPGGYCTHGNVLFPTWHRAYESAWEQILWQAAGTVAEKFTTPNKEEWLQAARDLRQPYWDWGYWPNDPDFLSLPDEVVRHEEVEITDFDGTRIKVENPIRRYKFHPIDPSFEGDFAQWPTSVRYPNAQKQENTEGMIAGMKAAAPGIRERTFNTLTKNYTWEHFSNHGAIYGTNANSLEMVHNTMHLLMGRDPTLDPLITGHMGSVPHGAYEPVFWMHHCNCDRLFALWQAMNYDVYVSEGMSYEATINYLPGQVLSEDSPLEPFYTKNQDPWQSDDLENWEVLGFSYPDFDAVKGKSKEERRKYISDLVRRRYGFVTTQTENPALRLLSSFQSAQSGHETQYALYDWVIHAKFRYYEINESFSIIFYFDEGEGCTLNSIIGTVDAFRGTTSETCSNCARNQELIAEGFVHLNYYIGNDIGKHVDRKADAVPIYEPAKVTEYLKKRKISCKVLSTGAKLPSLTVEIKGSPYYLPAGETRPQVDKEKPTVVLNDIIRVIT

SEQ ID NO: 3086 - protein, 765 aa, Agaricus bisporus
  source: /note="var. bisporus"
  source: /note="strain H97 / ATCC MYA-4626 / FGSC 10389"
MVLSSVLGFPRIGANREIKKAVEAYWAGKTSAEDLQKVAAEVRKTSWTSVKNHRVDFVPSGEFSLYDHVLDHSAAFNVIPQRYVGLGLTPLDVYFAMGRGRQSEGVDVPASEMKKWFDSNYHYVVPELSEETDLKLIYNKALEEFKEAKEAGITTRPVVLGPVSFLVLGKSAKSAQPGFRPISLLPKLIPVYKQLLSELKAAGAEWVQIDEPILALDSAAALEKEYTASFTELAPVSPKIMLTTYFSRLDSNVRFIAKLPVAGLHIDLDRAPDQLTEVANAVKNTPIVLSLGLVSGRNIWKTDFGAAIKLAQTAIDILGAGRVIVATSSSLLHTPVTLASENKLTAEQKDWFSFALEKAEEVAVIAAVLSGSQDASVTAALEANRVSINKRREFEKNSDDTVRKRVAAITPDQLNRKSPFPVRKETQAKHLNLPKFPTTTIGSFPQTKEIRQARAKFNKGELTKEEYETFIKKEIEHVVRFQESIDLDILVHGEPERNDMVQYFGELLNGFVFTQNAWVQSYGSRYVRPPIIVSDVSRPGPMTVKWSSYAQSLTKKPMKGMLTGPVTILNWSFPRADISREMQSKQLALALRDEVIDLENAGIHAIQVDEPAIREGLPLRRADWDGYLEWAVDSFKLATAGVTDQLQTHSHFCYSDFDDIFPSIQRLDADVISIEASKSDMKLLNTFKHYGYSNQIGPGVYDIHSPRVPGDQEIKDRLQAMLSILPDSLVFVNPDCGLKTRGWKETEASLKNLVAGAKWARQNYA

SEQ ID NO: 3087 - protein, 151 aa, Agaricus bisporus
  source: /note="var. bisporus"
  source: /note="strain H97 / ATCC MYA-4626 / FGSC 10389"
MSNTERTYIMIKPDGVQRGLVGKIIARFEERGFKIVALKMAHPTEDHLRKHYADLANKPFFPGLVKYMASGPVIAIVFEGLDAVKTGRAMLGATNPLASPIGSIRGDFALAVGRNICHGSDSVESANKEIDLWFPEGITSWKSVYEGWLYE

SEQ ID NO: 3088 - protein, 156 aa, Agaricus bisporus
  source: /note="var. bisporus"
  source: /note="strain H97 / ATCC MYA-4626 / FGSC 10389"
MSLVVPDQHQQFQHILRLLNTNVDGKRKVMYALTEIKGVGRRYSNIVCKKADVDLNKRAGDLNSDELERIVTIIQNPTQFKIPTWFLNRQKDIVDGKNSQILSNGVDSKLRDDLERLKKIRAHRGLRHFWGLRVRGQHTKTTGRRGKTVGVSKKRG

SEQ ID NO: 3089 - protein, 190 aa, Agaricus bisporus
  source: /note="var. bisporus"
  source: /note="strain H97 / ATCC MYA-4626 / FGSC 10389"
MRDILKTEELEIPEGVEVTINSRLITVTGPRGTLKKNVRHVDMDIRLLKGKTTRVSLAVWQGGRKHVACLRTIRSLINNMVTGVTKGFQYRMRAVYAHFPINCIIQDDGKSLEIRNFLGEKTVRHVNMLNGVIVSESKTQKDELILEGNDVDNVSQSAASIQGICRVRNKDIRKFLDGIYVSDKGTIDKD

SEQ ID NO: 3090 - protein, 216 aa, Agaricus bisporus
  source: /note="var. bisporus"
  source: /note="strain H97 / ATCC MYA-4626 / FGSC 10389"
MGRRPARCYRYCKNKPYPKSRYNRGVPDPKIRIFDLGRKRASVDEFPFCCHLVSDEYEQLSSEALEAARICANKYVTKTSGKDSFHLRVRVHPFHVIRINKMLSCAGADRLQTGMRGAWGKPYGTVARVNIGQIILSIRCKETNSQVIIEALRRARYKFPGRQKIIVSKKWGFTNVDKAEYTRLKEEKKVLQDGAYVQFIRPRGNLEKNLRNQLRA

SEQ ID NO: 3091 - protein, 262 aa, Agaricus bisporus
  source: /note="var. bisporus"
  source: /note="strain H97 / ATCC MYA-4626 / FGSC 10389"
MQMTTEVREDAVYLAKLAEQAERYEEMVENMKRVASSDQELTVEERNLLSVAYKNVIGARRASWRIVSSIEQKEETKGNETQVRMIKSYREKIEGELADICEDILDVLDKHLIPSAATGESKVFYHKMMGDYHRYLAEFATGDKRKDSADKSLEAYKAASDVAVTELPPTHPIRLGLALNFSVFYYEILNSPDRACHLAKQAFDDAIAELDTLSEESYKDSTLIMQLLRDNLTLWTSDMQEAESATAENKETEATDAQPTDD

SEQ ID NO: 3092 - protein, 268 aa, Agaricus bisporus
  source: /note="var. bisporus"
  source: /note="strain H97 / ATCC MYA-4626 / FGSC 10389"
MPPKAKPGTGKKPAAAPFGASKKTQVKKNPLFEAAPKNFGIGQDIRPKTDMTRFVKWPEYVRLQRQKVILNQRLKVPPAIAQFAHTLDKNTATQLFKLFNKYRPESKQEKKERLRAAAAATAEGKTVETKKPLFVKYGLNHIVALIEAKKASLVAIAHDVEPIELVVFLPALCRKMGVPYVIVKGKARLGTVVHKKTAAVAAIQDVKSEDQRELATLVSAAKANFTDKYDEQRRQWGGGIRGYKSTQMLRKRAKAAGQNPAAASLGKL

SEQ ID NO: 3093 - protein, 351 aa, Agaricus bisporus
  source: /note="var. bisporus"
  source: /note="strain H97 / ATCC MYA-4626 / FGSC 10389"
MAGLDSRQSDIHSYRQSTQWSRLSFLVLLVASVNLSLLLKCNPLVTELGLYDIVNTPGVAADLAHISTPAKVEGNLPDNDGLSKTLKGADVVVIPAGVPRKPGMTRDDLFKINAGIVRDLATGIATYSPKAFVLVISNPVNSTVPIVAEVLKKHGVYDPKRLFGVTTLDVVRSSTFVAEKHGNLSLATEVVVPVVGGHSGVTIVPLLSQSSHPLPNLSTTEYEALVKRIQFGGDEVVQAKGGAGSATLSMAYAGAEFANKVIKAFKGEKGLIAPSYVSSEADREGAALLTKELGKEVAYFSSNIELGPGGIAKINPLGKITDAERNLVKAAIPELEKNISSGVTFVVEARL

SEQ ID NO: 3094 - protein, 430 aa, Agaricus bisporus
  source: /note="var. bisporus"
  source: /note="strain H97 / ATCC MYA-4626 / FGSC 10389"
MSYKVADISLAAFGRKEIEIAENEMPGLMHVREKYRAQQPLKGARIAGCLHMTIQTAVLIETLTALGAEVAWSSCNIYSTQNHAAAAIAVTGVPVYAWKGETEEEYTWCIDQTLAAFKGGKPLNLILDDGGDLTRHVHDKYPQYLKDIRGLSEETTTGVHHLYKAFRDGSLKVPAINVNDSVTKSKFDNHYGCRESLVDGIKRATDVMLAGKVAVVAGYGDVGKGCSEALRGFGARVVITEIDPINALQAAMAGYEVTTMDEIASRGNVFVTTTGNRDIITGKHFNVMPEDAIVCNIGHFDVEIDVAWLKENAKSVSNIKPQVDRYTMANGRHIILLADGRLVNLGCANGHPSFVMSCSFTNQVLAQIALWTTPEKFPLGVHLLPKELDEEVARAHLGQLNVKLTELTETQSKYLDIPTNGPYKPSHYRY

SEQ ID NO: 3095 - protein, 576 aa, Agaricus bisporus
  source: /note="var. bisporus"
  source: /note="strain H97 / ATCC MYA-4626 / FGSC 10389"
MSDKISLIPLVGIPGEIKNRLNILDFVKNDKFFTLYVRALQILQARDQSDYSSFFQLGGIHGLPYTEWAKAQPQLHLYKANYCTHGTVLFPTWHRAYESTWEQTLWEAAGTVAQRFTTSDQAEWIQAAKDLRQPFWDWGYWPNDPDFIGLPDQVIRDKQVEITDYNGTKIEVENPILHYKFHPIEPTFEGDFAQWQTTMRYPDVQKQENIEGMIAGIKAAAPGFREWTFNMLTKNYTWELFSNHGVVVGAHANSLEMVHNTVHFLIGRDPTLDPLVPGHMGSVPHAAFDPIFWMHHCNVDRLLALWQTMNYDVYVSEGMNREATMGLIPGQVLTEDSPLEPFYTKNQDPWQSDDLEDWETLGFSYPDFDPVRGKSKEEKSVYINDWVHKHYGFVTTQTENPALRLLSSFQRAKSDHETQYALYDWVIHATFRYYELNNSFSIIFYFDEGEGCTLESIIGTVDAFRGTTSENCANCARSQDLIAEGFVHLNYYIGCDIGQHADHEDDAVPLYEPTRVKEYLKKRKIGCKVVSAEGELTSLVVEIKGAPYYLPVGEARPKLDHEKPIVILDDIIHRVN

SEQ ID NO: 3096 - protein, 685 aa, Agaricus bisporus
  source: /note="var. bisporus"
  source: /note="strain H97 / ATCC MYA-4626 / FGSC 10389"
MAFTQTKTDDVAIATIRTLAADTVSKANSGHPGAPMGMAPVAHVLFSRFMNANPKSSRWFNRDRFVLSNGHACALQYVLLHLLGYKLSLDDLKGFRQVDSKTPGHPEVGHTDGIEVTTGPLGQGFSNAVGLAMAQAHLAAVYNKEGFDLINNYTYAFAGDGCLMEGVASEAASVAGHLKLRNLIVIYDDNHISIDGDTAVAFTENVPQRFEAYGWQVLHVDDGDSDLTGIYNAIAEARKSTDKPTIIRLRTTIGYGSKLQGSHSVHGAPLKADDIVQLKERFNFPTDKQFYVPQETYDAYAEVGRRGAALEQQWNALLASYQQKYPKEHAELVRRIDGKLPEGWEKSLPVYTTADAAQASRKLSEIALTSISSVLPELLGGSADLTGSNLTKVKGSVDFQHPSTGLGTYAGTYIRYGVREHGMGAIANGLHAYGGIIPFVGTFMNFVSYAAGAVRLAALSGHQVIWVATHDSIGLGEDGPTHQPIETYIHFRATPNIAFWRPADGNETSAAYYSAITSRGTPSILSLSRQNLPNLEGSTIQNALRGGYVLVEEQNEALTIVSTGSEVNIAVDAAKKLKAEGIKTRVVSLPCWLTFDQQDQEYRLSVLRSGAPILSLEAASPTGWQKYSHEQFGLNGWGASGPYLKVYEKFGITGSNIAAVGKKIVEFYTSNSIPTVSPLLKAVQH

SEQ ID NO: 3097 - protein, 159 aa, Agaricus bisporus
  source: /note="var. bisporus"
  source: /note="strain H97 / ATCC MYA-4626 / FGSC 10389"
MQIFVKTLTGKTITLEVESSDTIDNVKAKIQDKEGIPPDQQRLIFAGKQLEDGRTLSDYNIQKESTLHLVLRLRGGAKKRKKKTYTTPKKIKHKRKKVKMSILKYYKVDSDGKIKRLRRECPSAQCGAGIFMAFHQDRQYCGKCGLTYTFAPGSKPPAV

SEQ ID NO: 3098 - protein, 189 aa, Agaricus bisporus
  source: /note="var. bisporus"
  source: /note="strain H97 / ATCC MYA-4626 / FGSC 10389"
MADPKSKPPTNPMKEPRIDKLVINISVGESGDRLTRASKVLEQLTGQTPVTSKARYTVRTFGIRRNEKIACHVTIRGPKAEEILERGLKVKEYELRRKNFSDTGNFGFGIQEHIDLGARYDPGIGIFGMDFYIVMGRPGARVARRRAKKNRIGFTHRIKKEDTMAWFKQRFDGIILVCGHQILLSTVAH

SEQ ID NO: 3099 - protein, 191 aa, Agaricus bisporus
  source: /note="var. bisporus"
  source: /note="strain H97 / ATCC MYA-4626 / FGSC 10389"
MPRAPRNHSKTYKIPRRPYEAPRLDAELKLAGEYGLRNKCEIWRIALTLSNIRRAARELLKLDPKDPKRLFEGNALIRRLVRIGVLDESRMRLDYVLALKIEDFLERRLQTQVFKSGLAKSIHHARVLIKQRHIRVGKQIVDVPSFVVRLDSQKHIDFALTSPYGGGRPGRVKRKRAAAAAKGGEDAEEEE

SEQ ID NO: 3100 - protein, 217 aa, Agaricus bisporus
  source: /note="var. bisporus"
  source: /note="strain H97 / ATCC MYA-4626 / FGSC 10389"
MVLKLYGTNISPPSRYAGLVLLEMKVPFELVNVDLGKKEQKSPENLANQPFGQIPYIVEDDGFILYESRAIARYIATKYANQGPKLIPTGDLKKIAKFEQATFAESAHFNDPAFSLLLEIFVKKMQGLTPDEARVTELKTTLLSKMDVYEQILSKQKYIAGDEITLVDLAHLPLASVMPDIGIDITTGRPHLTKWLNELLQRESWQTLKANGLVSTA

SEQ ID NO: 3101 - protein, 238 aa, Agaricus bisporus
  source: /note="var. bisporus"
  source: /note="strain H97 / ATCC MYA-4626 / FGSC 10389"
MKFNIANPATGAQKLIDTDDEKRIRIFYDKKISQEIPGDGLGDEWKGYIFRITGGNDKQGFPMKQGVLLPYRVRLLLSDGQSCYRIRRTGERRRKSVRGCIIGPDIAVISLVIVKQGDSEIPGLTDTVLPKRLGPKRATKIRKFFNLSKEDDVTKYVVRREVKSQKKENAKPYTKAPKIQRLVTPLRLQRRRHLRSLKRRKLEHQKEQKAEFDVIVAKRLAEKKAKVAAVKASHKTTA

SEQ ID NO: 3102 - protein, 242 aa, Agaricus bisporus
  source: /note="var. bisporus"
  source: /note="strain H97 / ATCC MYA-4626 / FGSC 10389"
MARSKELVPGVGRLSRSQVFTKRGLYKGIKKSDKPAGEEPAATKEKAVGGAKNGEKRVIPTVKAPRYYPTEDVRQPKKSRKSHNPPGLRSSITPGTVLILLAGRFRGKRVVFLKQLESGLLLVTGPYKANGVPLRRVNQAYVIATSTKLELPGFTVEHQVDEKINDAYFAKTSTKGARSAEEEFFEDGKPKAKETFPATKAADQKQVDSAILDAVKKTPDLVKYLKSTWGLSKGQYPHQLMF

SEQ ID NO: 3103 - protein, 312 aa, Agaricus bisporus
  source: /note="var. bisporus"
  source: /note="strain H97 / ATCC MYA-4626 / FGSC 10389"
MAEAKRVKTPKDFAIDFMMGGVSAAVAKTSAAPIERIKLLVQNQDEMIKQGRLATPYKGVSDAFTRTYKEEGLVSLWRGNTANVIRYFPTQALNFAFKDYFKSLFGFKKSEGYWKWFAGNVASGGAAGASSLLFVYSLDYARTRLANDAKSAKGGGARQFNGLVDVYRKTLASDGIAGLYRGFIPSVVGIIVYRGLYFGVYDSLKPVVLVGALEGSFLASFGLGWGVTIGAGLASYPLDTIRRRMMMTSGSGQNYKSMFDAGSQILAKEGTKSLFKGAGANILRGVAGAGVLSLYDKLQQVMFGKVYSGGSG

SEQ ID NO: 3104 - protein, 396 aa, Agaricus bisporus
  source: /note="var. bisporus"
  source: /note="strain H97 / ATCC MYA-4626 / FGSC 10389"
MAEVETTPTSAAADKKPSVSTLETDLTKYKVAADIVRDVIKKIIESTVEGAKLIDLCVEGDKLLEQGTGAVYNKPVKGVKVTKGIAFPTSISVNNAVAHFSPLASDPQSSQTISKGDVVKIQLGAHIDGFAAITAETIVVGASVDNPVTGRQADVIKAAWTAAEVAMRLVKVGNKNWAVTEGVAKAASAWDCKPVEGMLSCQQTQNVIDGKKRVILNPSEAQRKEFETATFAEGEVYGIDILISSGEDGKARVEESRTTIYQRDSAVTYQLKMKNSRMVFTEVQKKAGSFPFNIRILEDEKRARMGLQEAVQHSLVKPYEVIYTPNNTFVAGFHFTIALLPGGPALITHPPHWYKPELVKTEKELEDEELKGLVARNLRPSKKKGKKAGETEAKAE

SEQ ID NO: 3105 - protein, 471 aa, Agaricus bisporus
  source: /note="var. bisporus"
  source: /note="strain H97 / ATCC MYA-4626 / FGSC 10389"
MPPIFDKPTTDKYDYVVIGGGSGGSATARRAALYGKKVAVVETDPYLGGTCVNVGCVPKKIMWHAADLQDRLNHHYPGYKFNGIANAQFDWATFKPQRDAYIHRLNGIYARNFEKEGVEFHHGTARLTSPTSVEVKRGDGSTYTLNGDRITICVGGRPNSPSEKQIPGASKGIDSDGFFGLNEQPKRVAVVGAGYIAVELAGVLNALGSETHLIIRGESVLRTFDPMIQETLTPWMEKTGIKIHKSSQVTSVEGEKGQTLTVKTNKGEQIDVDVVLWAIGRSANTEGLGLEELGIKLDKKGDIVVDEYQNTNVKNVYAIGDVAGKWLLTPVAIAAGRRLSNRLFGPPEYKDEKQSYENIPTVVFAHPPIGTVGLTEPQARQKHGDAVKIYTSSFKSLYFSMVEEEHKEPTVYKLIVVGPEERIVGIHMIGQGSDEAMQGFGVAVKMGACKKDLDDTVAIHPTSAEELVTLR

SEQ ID NO: 3106 - protein, 797 aa, Agaricus bisporus
  source: /note="var. bisporus"
  source: /note="strain H97 / ATCC MYA-4626 / FGSC 10389"
MAVVGVDFGTLHSKIGVARHRGIDIIANEVSNRATPSLVAFGPKQRSIGESAKTQETSNFKNTIGGLNRLIGRTFDDPQVQNVEKNFTHAALVDLNGTIGVEVNYLGERQQFSFTQLVGAYLGKLRDITANELKTGVTDIVIAVPGYYTEIQRRAILDAAAIANLNVLRIINDTTATALGYGITKSDLPDPENPRHIAFVDVGHSTFSVAIVAFAKGQLTIKSTAYNHNLGGRDIDYVLLKHFAEEFKTKYKIDVLANPKAIFRLAVGCEKLKKILSANAEGPLNIESIMNDVDASSKMSRDQLEALIPSLLDGIDGPIKQALAESGLTVDQIDSVELVGGSSRIPSVRTRISQAFNNKPLSVTLNQDEAVARGATFACAMLSPVFRVRDFHIHDINHYPVQVQWQAVPTDPDEDTEILLFPQGNAIPSTKILSFYRRQAFHVDAAYKDPSGLPGGIKPVIGGFDVTDVPPDPKGDSTIVKVKARLNLHGIVSFENTYVEEIEEREVEPAPMDVDQQQNATATSSGAAEGEAAPPVPPKKKKIVKKKEVPFFTTTSSLDKKTLEQLRERESEMHAADKLVQDTEDRKNALEEYIYDTRGKLDDRYAAFVTADEKSKLLQELSAAEDWLYTEEGEESTKSVYVSRLDALKTLGDPITFRYRETEDRQKSVAALRETLNNYMNQATSNDEKYAHIDGKDKESIVERVAVIQKWLDDMSVRQAERRKDVDPVLTSEQVTKKRDEIIFFATPILTKPKPKMPTGTGTDSGTGTPRRDGTPQPPPPQKNEQEGGKDASMDVD

SEQ ID NO: 3107 - protein, 931 aa, Agaricus bisporus
  source: /note="var. bisporus"
  source: /note="strain H97 / ATCC MYA-4626 / FGSC 10389"
MAEINEAKSASTESFVTALVFNAIVFGVEIGVFTLIRPYFKAIYEPRTYAPAPSERSEPLSRNIFLWPVALWRADFRSIKHANGMDAYCFVRFLRMMVKVFLPIWIISWIVLLPTTAVGTSNPGKDNLDKLTFGNVSPDQYKRYAAHLILAWFFTFWVLYNIVHEMRHFITARQQHIIEPNHAKSLQANTILVTGIPDRYLNRRSLLDLFDELPGGVKKIWINRNLKELPEIYSRRLSACNKLESAETALLRTAAKIRQREEKKKSKASKKTVPVSKEHTHTHSEDLETAAIVVPHGQRPTHRLGFLPFTGKKVDTIDWAREEIVTCNRLLEEGCAAIRADDEASNEVQNPGEFSSDASSAKLSTFLLSLSTSICNNFPAVGLKPVAAIKNTTTAIKARFAGYGDSKYPPFNSAFVTFHKQIAAHLAVRVLTHHEPYSMTNKYNEVSPQDVIWANLNMNPYEQKIRMAISYAITAALIIFWVIPVGRRALSNVPSLCNQFSWLAWICGLPPVIVGIISGVLPPVLLAILMALLPIVLRLLARFEGIPKYTGLELSLMTRFFIFQVVHSFLIVTVTSGIVAALEGLVESPTSTPNILANELPKASTFFLTYIILQGLAGSGSGFLQIVRLVIYYVKLIVLGSTPRSVYNIKYVLGNVAWGTLFPTITLLTVISLAYSIISPVINGLACATFFAFYQLYKYLFLWVYEQNPSGDTGGLFFPKAIQHVFVGLYIEEICLCALFFLARDPNDNASAVIEGALMIVLIVLTAGFHAIFNNSYDPLLQALPLSLKDKTYSPATGMTEGRNPRKSEAGNDNHEIVEEMRGIEGDDEDDVSSKHKGKRPENEKVGQVGEGTAARHTREDAEFGFAHPAISRPQRTLWIPRDTLGLGEGEVAACEDMGLNASMSGAVMNEKGKVDVPTADDVPGEIVVRL

SEQ ID NO: 3108 - protein, 159 aa, Agaricus bisporus; identical to SEQ ID NO: 504
  source: /note="var. bisporus"
  source: /note="strain H97 / ATCC MYA-4626 / FGSC 10389"

SEQ ID NO: 3109 - protein, 156 aa, Agaricus bisporus
  source: /note="var. bisporus"
  source: /note="strain H97 / ATCC MYA-4626 / FGSC 10389"
MPGVRDISADAFIAAYASYLKKSGKLEVPPWVDIVKTGAYKELAPYDADWYYIRSAAVARHIYLRKDVGIGALTKLHGGRKRRGNRPSHHAASSSNVQRKVCQSLEKIGVLEKSDNGGRRITESGQRDLDQIATQVFDQTKEDDDEEEEEEEEEEE

SEQ ID NO: 3110 - protein, 201 aa, Agaricus bisporus
  source: /note="var. bisporus"
  source: /note="strain H97 / ATCC MYA-4626 / FGSC 10389"
MGAYKYIGELYKKKQSDVLRFITRVRCWEYRQLHVIHRASRPSRPDKARRLGYKAKQGYVIYRIRVRRGNRKKPVPKGATYGKPVRQGVNHLKPQRSHRTVAEERVGRRCGNLRVVNSYWVNQDGVYKYYEVILVDPNHKAIRRDPRINWIVNPVHKRREARGLTSSGKQNRGLGKGHRHNHNPGYSVWKKHNTLSLRRYR

SEQ ID NO: 3111 - protein, 325 aa, Agaricus bisporus
  source: /note="var. bisporus"
  source: /note="strain H97 / ATCC MYA-4626 / FGSC 10389"
MSFGKTITLSNGAKMPRIGLGTWQSKPHEVENAVEIAVRNGYRHLDLAMIYQNQDEVGRALKKVIPSVVKREELFITSKLWNNAHQPDQVENQLDETLKQLGLDYLDLYLIHWPVAFPPGNGFFPPHSSLKDEVELDTETSLVDTWKAMLALPKSKVRAVGVSNFTVEHLKGIFDATGVHPVANQIEAHPLLQQPELVKYCQEHNIHITAYSPLGNNSEGKPMHTENPVVVEIAKRLNATPAQVLIAWGARRGQSVIPKSVHEDRIISNFKEVEITDDDFARMNKIGEGDLWHRYNIPFFYNPCWSISTFSEDREKGARVPVKIN

SEQ ID NO: 3112 - protein, 481 aa, Agaricus bisporus
  source: /note="var. bisporus"
  source: /note="strain H97 / ATCC MYA-4626 / FGSC 10389"
MSAHHGESTLRPEPDKVLQDIANYVHGYKIDSPLAFETARLCLIDTIGCGLEALRFPECTKLLGPVVEGTIVPNGTRVPGTSHQLDPIRGAFNIGTQIRWLDYNDCFLAAEWGHPSDNLGAILAVADHLARQGQPLTVHDILEAMIKAHEIQGGLALLNSYNRVGLDHVVLVKVASTAVVSKLLGLDRDQTVDAISQAWVDGQSLRTYRHAPNTGPRKSWAAGDACSRAVNLALLVKKGEKGLPSVLTAKTWGFYDVLFKGKAFEFQRPYGSYIMENVLFKISYPAEFHAQTAVEAAHTVHNKLKVIGRTSDDIKSVRIRTQEAAIRIIDKQGPLDNFADRDHAINYMVAYPLIFGELTSESYTDASAADPRIDALRAKIHCVEDSRFSVEYHDPEKRSIGNALLVELNDGTILDEVEVEYPVGHKRRRAEGTPLLINKFKRHISYHFDDARQKKILDTVSDAQNLAKMPVDKFTDLFVKA

SEQ ID NO: 3113 - protein, 478 aa, Agaricus bisporus
  source: /note="var. bisporus"
  source: /note="strain H97 / ATCC MYA-4626 / FGSC 10389"
MPQITSGATAQSAFATQPTEKDPYRYQVGFGNSFASEALPGVLPEGQNSPQKNKYGLYNEGMTGASFVAPRAENRLAWLYRIRPSVAHQGFTRLPDNPDLESNFLPTNKNVHVSPTQLAWLPFKLPADSEKVDWVDGLKTIAGNGDPTLREGLAVHMYLANKSMDKRAFCNGDGDMLILPQQGRLDIQTEFGKMMVRPGELCVIQRGMKFKVILPDGPSRGYIQEIYGTHFELPELGALGGNGLANRRDFETPVACFDIDQSSWEIVYKVSGQLHACHQEHTPFDVVAWHGNYVPYKYAMEKFIFVGSISKDHIDPSCFCVLTAKSKHNNAPLVDFLILGERWDVATNTFRPPYYHRNSSTEFMGLIHGVYGGRSDGFQPGGASFETGFCPHGVSYDVWKAASEHPLTPEIVHKGVLAFMFESSMPFTITEYAMNRCGTKHEHEPQMWDNLKAHFMNHLDEINADLKAAKLPLLGSNR

SEQ ID NO: 3114 - protein, 678 aa, Agaricus bisporus
  source: /note="var. bisporus"
  source: /note="strain H97 / ATCC MYA-4626 / FGSC 10389"
MSLTPPQSPLQWDHAAQDISRLTQQAIDADRALQDKVAALDPKNCTFESVFVELAFAETKLDAITEPLAFYQNVSPSKELRDASNEAEALVRDYGVESSMRVDVYKAKVAARDNLKKSGQRDKLSSEEQRLVDKMILDGTRAGLALDETSRVKLVELKKELSKTCLDFSKNFNEENGVVTFTLEELKGVPEDVVSGFTKRTENGKDVYDVTYKTPDIFPLFKFAENPNTRQRAQEGYESRLAINVPLLDRAIELRRQISGILGYDTWADFITEVKMIKSGNGIKDFLDDLENKLRPVGMKERETLLAMKKKEHEQKGYPFDGEFYIWDYRYYDRKYIEETLDLDDMLVKEYFPVSVVVPTILQIYQDMLSVKFIEIETSTWHPDVQKFAVWEKGAKDESGFIGYCYLDLFPRTAKYSHAAVWPILPGYDKADGKRSYPTTAMVANLAKPTPDKPALMRHDDVVTFFHEMGHVFHGLLSQTKFARFHGTSVARDFVEAPSQMLENWCWEPKVLERMSSHYEKKEPLAKDLIEKIIKSRYVNVGLFYLRQLFFAKYDYKVHTDKESSDYTRLWNDLREKISLVKYKVAAPGQGTFGHITGGYDAGYYGYTYSLVFASDMYATVFKGDPLDPKHGSHYRQEILLPGGSREELDSLKAFLGRPPNSDAFLKELFGDNPTSNL

SEQ ID NO: 3115 - protein, 701 aa, Agaricus bisporus
  source: /note="var. bisporus"
  source: /note="strain H97 / ATCC MYA-4626 / FGSC 10389"
MSAPESFGFQAEISQLLDLIINTFYSNKEIFLREIISNSSDALDKIRYASLTDPSALDSERDLYIRITPDKENKILTIRDTGIGMTKADLVNNLGTIAKSGTKGFMEALNAGADISMIGQFGVGFYSAYLVAERVQVISKHNDDEQYIWESAAGGTFTIALDTVNPPLGRGSEVRLYLKEDQYEYLEEKRIKDIVKKHSEFISYPIQLAVTKEVEKEVEDEEEVKEEDGEKSKIEEVDEEEENGEKKKKKTIKEKEVTNEELNKTKPIWTRNPQEITTEEYASFYKSLTNDWEDHLAVKHFSVEGQLEFKAILFIPKRAPFDLFESKKKRNNIKLYVRRVFIMDDCDELIPEYLNFVKGIVDSEDLPLNISRETLQQNKILKVIRKNIVKKTLDLITEISEDKDNFAKFYEAFGKNLKLGIHEDAQNRSKLAEFLRFYSTKALDDQISLKDYITRMPEVQKSIYYLTGESLAATKDSPFLEVLKRKGFEVLLLVDPIDEYAITQLKEFDGKKLVCVSKEGLELEETEEEKASREAEVKEYTELCSTVKDALGDRVEKVVVSNRITDSPCVLVTGQFGWSSNMERIMKAQALRDSSMSSYMASKKTLELNPNNAIVKELKNKVMEDKADKSVRDLTFLLFETALLTSGFSLDDPTSFAKRIYRMISLGLDVDEDEVPPALESTTAAPAAEATASASAMEEID

SEQ ID NO: 3116 - protein, 737 aa, Agaricus bisporus
  source: /note="var. bisporus"
  source: /note="strain H97 / ATCC MYA-4626 / FGSC 10389"
MAHTAHPFSSVPSAAVRRRLSSSVSAKKPLVTATFSSLTPMWAGVAGVIINNNTEFEVAVSVHDSVYSTDFASVVLPYDPNDPEKNAKTIEQYILQVLRRFSVEHLCKFLGAGVTLTLLREVPNVCTRLWLDLDIVPFVFNIKQYHTDSLTRPNIKHRISSTTGSYVPSGAETPTVYVDSAHLKAMSGLQTGVSGRLPIQRTLDEQADSAARKCLMNFGPGNNPRLNIGPRNQVLVDDGGRVHLLDDLDEYRNTVGPRTWNAVIKLADELREKKVKIGFFSSTPQGGGVALMRHALIRFLTALDVDAAWYVPNPSPAVFRTTKNNHNILQGVAAPDLRLTEEARDAFDAWILKNGLRWTAEGGPLARGGVDVAFIDDPQMPGLIPLIKKIRPELPIVYRSHIEIRSDLVHVPGSPQEEVWKYLWKNIQLADLFISHPVSKFVPQDVPLEKVALLGAATDWLDGLNKDLDPWDSQYYMGEFRALCARERMLELRWPQRDYIIQVARFDPSKGIPNVIDSYVKFRELLKLKSPELDDEDHPQLLVCGHGAVDDPDASIIYDQIMQIINSEQYEAYAKDIVVMRLPPSDQLLNSLMSNAKIALQLSTREGFEVKVSEALHTGKPVIASRTGGIPLQIEHGKSGYLCTPGDNEAVAGHLYDLYTDEILYKTMSDYAKTHVSDEVGTVGNTAAWLYLAVMYNRGIKIKPNGAWLNDLLRTETGEDYEEGEPRLPRGGLKMQG

SEQ ID NO: 3117 - protein, 767 aa, Agaricus bisporus
  source: /note="var. bisporus"
  source: /note="strain H97 / ATCC MYA-4626 / FGSC 10389"
MAAGVATAATRIGDTKVAMSAFEKDSFINYQRIEDNLAVVRNRLKRPLTLSEKVVYGHLDDPHGQDINRGVSYLKLRPDRVACHDATAQMALLQFMSVSMDTAAAPTTIHCDHLIEAQIGGVKDLQRAVQTNKEVYDFLATVTAKYGLGFWKPGSGIIHQILLEHYAFPGGMMVGTDSHSPNAGGLGMVACGVGGADAVDVMAGIPWELKCPKVIGVNLTGKIGGWTTPKDVILKVAGILTVKGGTGAIVEYKGPGVESLSCTGMATICNMGAEIGATTSLFPFNRRMADYLQATKRSDVANYAKAFAHNLQADEAAEYDEHIEINLSELEPHINGPFTPDLATPISKFASEAKKNGWPEEVKVGLIGSCTNSSYEDMTRSASIVKQAADRGIDFKSKFTVTPGSEQVRATIARDGLIDSFESAGAIVLANACGPCIGQWDRQDVKKGEVNSIVTSYNRNFTGRNDANPATHAFVASPDITTALAFAGRLSFNPLTDELIGSDGKPFKFSDPSGNELPPRGYDPGEDTFQPPPQDRASVQVAIDPKSDRLQVLTPFKPWDGKTPSDLPVLIKVKGKCTTDHISAGGPWLKYRGHLENISQNCLIGAINAENGEANKIKNQITGEYDGVPQTAAYYRERGIKWVVIGDHNYGEGSSREHAALEPRFLGGLAIVARSFARIHETNLKKQGMLALTFIDPADYDKVRPDDKVDILGLEAFSPGRNLTLVAKHTDGTQDEISLAHSFNEGQIEWFKAGSALNLIAAKAKSA

SEQ ID NO: 3118 - protein, 867 aa, Agaricus bisporus
  source: /note="var. bisporus"
  source: /note="strain H97 / ATCC MYA-4626 / FGSC 10389"
MVTTGNKFAVSRSLEDWSFTQVGGGQGTKDGEWLKVSNFPTTVHVELLKLGRIPDPFIGLHEWDVQWVGEAEWAFRINFDVTREELDFPHLDLVFGGLDTFAAVTLNGHDILKTSNQFIEHRVAVKDRLTIGLNELVIHFESAFLKGRDTEKQHGKFNLWNGDSSRLHVRKAQYNYGWDWGPILMTVGPWKPITFEAYTNRIVDVDIRARVNEDLSVNLSADVTFAEKKSGFMVFSLSGPDGAATASISPTATDSGQAKVSLAFPPGKLSLWYPIGYGKQSLYTASIKFTDEHGDVVDSKTQTIGFRRVRIVEKKLVDQEGLTFLFEINNIRIFCGGSNWIPADSFLTAVTPKRYRDWLQLAVDGNQNMIRVWGGGIYEHDSFYESCDGKSHLLAMWISFLVWQDFMFGCGQYPAYDSFVESVREEAVQNVKRLRHHPSVVIYDYQLAESLNLELDYADETSDFRDTNFPARYIYERVLPEVVQALTDTYYHRASPYSGHGKVTTDPKFGDIHQWNVWHGSQEPWHNWDILAGRFVSEFGMQGYPNVRTVDNWLGGDVSERFPQSRVCNNHNKADGFERRLELYLVENFRHAFDMESYIFYTQVMQAETLASAYRLWRRNWRGPGREYTAGALVWQLNDCWPVTSWAIVDYFLRPKPAYFAIARELRPYTVGMTRKEYQKFDDDRTAAFFKIETVLEIWGTNSTLEEKKARLELTAFDLHSDWIEGWTKEVVLAPNSSTEIYKGGAPGLPVRTKKSEAARTVIFSARLLGDNEDVLGRYSNWPEPFKFVKFPSVKDVGLGITVGRDGETVTLSALKPIKGIVLDVDGEDVKWSDQAIDLAPGDPQIIRAVGLKGREVKARFLGDGTA

SEQ ID NO: 3119 - protein, 162 aa, Agaricus bisporus
  source: /note="var. bisporus"
  source: /note="strain H97 / ATCC MYA-4626 / FGSC 10389"
MSNVFFDITVDGQAAGRIVFKLYDDVVPKTTKNFRELATGQHGFGYAGSSFHRVIPNFMLQGGDFTRGDGTGGKSIYGEKFADENFARKHTKPGLLSMANAGKNTNGSQFFITTVVTDWLDGKHVVFGEVVEGMDLVKKVETLGSQSGKVSKKVTIANSGTC

SEQ ID NO: 3120 - protein, 213 aa, Agaricus bisporus; identical to SEQ ID NO: 488
  source: /note="var. bisporus"
  source: /note="strain H97 / ATCC MYA-4626 / FGSC 10389"

SEQ ID NO: 3121 - protein, 256 aa, Agaricus bisporus
  source: /note="var. bisporus"
  source: /note="strain H97 / ATCC MYA-4626 / FGSC 10389"
MADAPRGRGGFGRGRDRGRGRRGPRRGGRKEEDKEWVPVTKLGRLVKDGKIKSMEEIYLFSLPVKEFQIVDFFLPKLKDEVMKIMPVQKQTQAGQRTRFKAFVAIGDFDGHVGLGVKCAKEVATAIRGAIILAKLSVIPVRRGYWGAALGEPHTVPTKVSGKVGSVMCRLLPAPRGTGIVAAPACKRLLQLAGVQDVYTQAQGSTATMGNFLKATFAAITKTYAFLTPDLWREIPLSRLPFDEFSAHLALSATKKY

SEQ ID NO: 3122 - protein, 293 aa, Agaricus bisporus
  source: /note="var. bisporus"
  source: /note="strain H97 / ATCC MYA-4626 / FGSC 10389"
MASKLPSVLSATEDEIQLLLAAQCHIGTKNCDKQMIPYVWKRRSDGIHIINIGKTWEKLVFAARIIAAIENPNDVCVISARPYGHRAVLKFAANTGAQAIAGRFTPGSFTNYITRSFKEPRLIIVTDPRVDHQAIREASYVNIPVIALCDTDAPLQFVDVAIPTNNKTKHSIGLIWWLLAREVLRLRGTIPRSPDGWNVMVDMFFYRDPEEVEKQQQEEAAAKAAVTAGEEAPAPTEWDVSGGHQAGAINPALVETSLDWAADAAPTNTDWAAEPAVGNWAADAPATGGGGWD

SEQ ID NO: 3123 - protein, 337 aa, Agaricus bisporus
  source: /note="var. bisporus"
  source: /note="strain H97 / ATCC MYA-4626 / FGSC 10389"
MLCRAALRSSSARLFSTSAARQTKVAVLGAGGGIGQPLSLLLKSDPLVSSLSLYDIRGAPGVAADVSHVDTASEVNGYPADKIDAALDGVQVVVIPAGVPRKPGMTRDDLFNTNASIVRDLATAVARASPSAHILVISNPVNSTVPIVAAALEKAGVFDPRRLFGITTLDVVRAQRFLAGIVESDPRQTPVTVIGGHSGATIVPLLSQSQYGKGIKGETYDKLVHRIQFGGDEVVKAKDGAGSATLSMAYAGAKFTNLLLRGLNGEKGVITPTFVRSPLYESQGIDFFSSSVELGLQGVEKIHPIGDISPEEEKLLAACLPELKKNIEKGKAFVAPN

SEQ ID NO: 3124 - protein, 425 aa, Agaricus bisporus
  source: /note="var. bisporus"
  source: /note="strain H97 / ATCC MYA-4626 / FGSC 10389"
MPENKGRVLLAYSGGLDTSCILAWLIEEGYEVYAFMADVGQEEDYAAAEKKALKVGAKKFFLADLKREFVTELIYPAVQANCIYENVYLLGTSLARPVIARGMIEVADKEGCDYVSHGCTGKGNDQVRFELAFYGLKPDIKVIAPWRIPEFYNRFAGRQALLQYAAEQNIPVQQTVAKPWSTDENLFHISYEAGILEDPNVTPPNDMWKLTTAPEDAPTSPERIILEFQNGLPTKVIVPEQQKEYTDAVEIFSALNTLARKHGIGRIDIVENRFIGVKSRGCYESPGATILRVAHMDLEGLTLDRNVRALRDQFTTIALSRILYNGHYFSPEREFVTSSIPSSQRTVNGIVRLKLYKGNTIVEGRESSEGLYDAAQSSMDELGGFEPTDTTGFISIESIRLKKWAQSKAAKGQSGVTAKDVYGSS

SEQ ID NO: 3125 - protein, 444 aa, Agaricus bisporus
  source: /note="var. bisporus"
  source: /note="strain H97 / ATCC MYA-4626 / FGSC 10389"
MVQLSKVLGVIILARNGDRYNYYQDPYTYAGSNTETTALGEVESHRLGSLLRSTYFDSSSSSYIEGIRSDLVDNNEVKVRVKAGVEGTVVFDSAIALLQGLFPPNPKNKITLANDTTVVAPLGGYQYVPVETVEPGNDRSLESWTNCPAFQKHIKEFYASEDFKAKAKDAQPFFHAAKDFVFGRPTTLENAWNIYDFVNSQLIHNKTYAHRLPPTFVEQAHHFANYHENGVFSDKDIVGIGNIAGRTLLHTILSSLERIAFNGDPLQFMVIQTTYQPFISFFHQTGIIKEHPEMKGIPDYSSAIAIELRRGSPPDVRDFLRIKFKNGTHPHFKDVHVFGHHADIPLTEFIYRAENAAITSNKQWKEVCNGNSATFDVAEMVTGNDSTMRAMLTGGSTLVTLVCLFIITKLVRRYRQRAREARLRLDGEENINVNVPVMEKTRLI

SEQ ID NO: 3126 - protein, 480 aa, Agaricus bisporus
  source: /note="var. bisporus"
  source: /note="strain H97 / ATCC MYA-4626 / FGSC 10389"
MATANTPAFNKMLYAPLAEIDPEVKNIIDKETWRQFTGLELIASENLTSQATMEANGSILTNKYSEGLPGARYYGGNEYIDELEVLCRKRALTAFNLDPAVWGVNVQPYSGSTANFAALTALIQPQDRLMGLGLPDGGHLTHGYYTAKKKMTASSIYFQSYPYAITPDTNLVDYAALAAQAKVFKPRLVICGASAYPRDWDYGKLREICDKEGAFLMADIAHTSGLIAAQELDNPFEYCDVVTTTTHKTLRGPRAGLIFFRRDRPNAPDLEKRVNDAVFPACQGGPHNNTISAIATSLLQVSRPEWKAYAKQVIANARALGESLVANGYKLQTGGTDNHLVLMDLRPLGLTGSKVEKICDLMGITINKNAVSGDASAQVPGGIRLGTSALTSRDMKEEDIKVVADFLHRAVQLSLLVQKEAGSKLLKDFVRVATTPQEGKQGYAQVKQLRDEVRDFASKWPLPGVQTAGLQKPEGYHEDF

SEQ ID NO: 3127 - protein, 500 aa, Agaricus bisporus
  source: /note="var. bisporus"
  source: /note="strain H97 / ATCC MYA-4626 / FGSC 10389"
MPSIFTHQWDTPVYKGSTSINTGLFINGEFVDGVKNTTIDVVNPANGKLITKISEATEADIDIAVEAAHKAFETTWGLNCSGSKRGDMLYKLAQLMEKNIDDLSAIEALDNGKTFLWAKSVDLSLSISTIKHYAGWADKNFGQVIETDEKKLTYSRHEPIGVVGQIIPWNFPLLMLAWKIGPALATGNCIVLKPSEFTPLSALRMCALIQEAGFPPGVVNVVTGYGSTTGQAISSHMKIDKVAFTGSTLVGRKVMEAAAKSNLKNVTLELGGKSPVVIFDDADLEQSVNWTAHGLFWNHGQACCAGTRIFVQEGIYDKFLQKFTDKIKEIKLGDPFGLGIDQGPQVSQIQYDRIMSYIESGRAEGATVHVGGERHGNEGYFIQPTIFTDTTPDMKIVKEEIFGPVGAVIKFKDGKEVIKQANDSNYGLAAAVFSQDINKAIETAHAFKAGTAWVNCANTIDAGVPFGGYKQSGIGRELGEYALHNYTNVKAVHVNLNWKM

SEQ ID NO: 3128 - protein, 503 aa, Agaricus bisporus
  source: /note="var. bisporus"
  source: /note="strain H97 / ATCC MYA-4626 / FGSC 10389"
MPQTYTHTFDTPVYKGSVTFNTGLFIDGQWVDPVDGGDRIDVVDPCTGKVITTVAAGTSKDVDIAVAAAEKAYKTSWGLKVPGVERGKLLGKLADLVEKHSDELAALEALNVGKHFHVAKMADIPLAVNALRYYAGWADKVHGKTIETTENKMAYTRHEPYGVVGAITPWNFPLGTVSFKIAPMLATGNVVILKPSEITPFTALYLASLINTAGFPPGTVNIINGYGNTVGEAISRHSSIRAIGFTGSTLTGRKILKASAESNLKKVTLELGGKSPTIVFDDANLEQAIKWASMGIFFNMGQACVAGSRIYVQEKIYDQFLKGFTKTAEVLAGATGGPFEPGVQHGPQVSNLQFERVMGYIKSGKSEGAKVLIGGERHGDTGYFIKPTVFTEAKPDMKIMQEEIFGPVCSVVKFKTEEEVTEWANNTTYGLAASILTENVARAIRMASNIEAGSISINSGPSAEPNVPFGGYKQSGIGRELGQYALDTYTQVKAVHINLGQKL

SEQ ID NO: 3129 - protein, 543 aa, Agaricus bisporus
  source: /note="var. bisporus"
  source: /note="strain H97 / ATCC MYA-4626 / FGSC 10389"
MVAFRRGASYGRKYLSTAETFDGACLQEGVLLPQIHDQLWANLTTTFGSHDYQSKAITWLSEAIQVRTITNDAMGAIGVDTDWKEFTRFHEYLEKAFPLVYSNLKVTKVNTYGIIYEWKGASPGLKPILLAAHQDVVPVDENTIHQWHYRPFDGHFDGEKIWGRGASDDKCGLIGVLIALETLISHEYRPARGIVLASGFDEEIGGLRGAATLAPVLQELYKDGFAFVIDEGTGFGKKFGTNFAMVGTAEKGATNVEVKVASAGGHSSLPPDHTSIGMLSAMLTHLESNPSELEFSRAHPFYGTLQCFATHAENMPSDYRKLIIASATSDGAMRKLIETISQDHLLKNFIGTTQAINVIKGGIKANALPEQAAAIVNHRISVTSNLTETKGRYVWLLKDFASQFDLSFTAFGEVIAEGSKGSLTVGEPFHQGLEPAPITSSDKPPYRLLSGTIKATFNSHRGLTGVNNIAVVPGTMPGNTDTRFYWNLSPYIFRYNHQNFGDVLDSVPKGMHTVNEYTEADSFMEMIEFFTMLILNADESTHL

SEQ ID NO: 3130 - protein, 551 aa, Agaricus bisporus
  source: /note="var. bisporus"
  source: /note="strain H97 / ATCC MYA-4626 / FGSC 10389"
MASERQIEELPSYKYAYILTASACLGSVFHGWDVGLIGGILSLRSFQEYLGINTKNAVKKAILDGNIISVLQAGCFFGALGTGYLSSRFGRRPCLIASGIVYITGGLLQCTVGLGPSQAAALHVFYIGRFISGIGVGMVSTLVPLYISECVPRTIRGRCTGTLQFATNSGLMLGFWVNYSVSKNVPFGEMQWRIPLIIQMIPSLLFIIAMFFQPESPRWLVEHGKHKEAATVLARTGGKDVDHPSVVQTLEEIKQEFVASKQPSFLKQIRLVGESRAVALRCFIPPLVMFFQQWTGTNAINLYSPEVFRHLGIHGTSGALFATGVYGVVKVVSVALALTFAVERFGRKRGLIFGGIGQALMMFWLGGYSATHQDGTVSPASHVSIVALYLYGAFFSMGWGPLPWVVAGEVAPNHVRSFALSIAVGTHWLFGFVISKVTPIMLDRIKYGTFLLFGFCCMIVATWAYFCLPETSGFALEDIKYLFERDVIIRSLQDAPGGKIFLGGRRVESVASLKERRVGVAGEQGEKITGLNSELEDVSSKKSTLKETSSV

SEQ ID NO: 3131 - protein, 720 aa, Agaricus bisporus; identical to SEQ ID NO: 828
  source: /note="var. bisporus"
  source: /note="strain H97 / ATCC MYA-4626 / FGSC 10389"

SEQ ID NO: 3132 - protein, 1020 aa, Agaricus bisporus
  source: /note="var. bisporus"
  source: /note="strain H97 / ATCC MYA-4626 / FGSC 10389"
MSKRLSGIFTRQPSTSTGAGNNDDFVPPQTPKSMNNLRAQLKRGTISQPSAVAAVVDAVRHKNAIDDRKLLLEHALALISNMEEGSMATAAKNKIIQLFYSDLTHPASTSLGPKFAWRAPDGARNNPDLPDMGRAGTPYSRSVQQTHPLPADQLPDPGLVFDTLLRRESFVEHPGGLSAMMFSFAALVIHSVFRTSHRDVYINETSSYVDLSPLYGHNEDVQKKVRAYNGLGYLHPDTFGEDRLRFLPPAYIAKKLYEINERGTYKDPANLTPDKRGDQDEEIFQTARLVNCGWFGMIVFSDYFSAILGLVRYGNNWSLLPFDEIRQDDHTLYERGKGNVVSVEFNCLYRWHATTSKSDEEWTMQAFRKIFGPDAKPEDFTPEDFKKIAKQAITAKPDPSTWTIGGLERQADGSFRDEDLANVLQNATEDPAARFGARGIPASMRLHEIMGLEQSRAWGVCSLNEFRRFLGLKVAKCAEKLYGNIENLELYVGLQAEEAKPLMEGAGLCPGYTISRAILSDAIALTRGDRFFTHDFTPYNLTAWGFADCQRDPGAFGFGSTMGRLLLRTLPDHYSENSVYTFFPFMTPKSMHTNLENIGVLKQYDLDRPSVRPSSVTFSDYKDVAHILESTADFDVVYKEHASRVIKGSGFYPVEDEKARNDVINALSGSPKLVDSIGRYFYETTQKLILENSFTFVGGETFGIDLIKYVVREVPVHWAATDVAGIQLKTKENPCGEYTPTELFDILSDIYSFIFIDIEPSKVRVLQYKVEKHIKDLLDLIEIHLGVGNRFTINGIIGTVSSFFHKSKRSEEHHEIVKRIDELGYSTDQLANTILAIMVSSVGLSLTLTNIINLYLGSDHDDTLKKLARHDDPQVFTGFVYEGLRLDPAFQGYYRVATKDQTIGKNELKKGDRVFADIGSANLNEKMFSEPSKVDPSRSTSACIFGDGPLRFLGETLTVKITSQVLRAIYAYNNVRRAPGASGKLKRFTEGSHPQYHFAYLDRDFKISPWPTSLTIQYDA

SEQ ID NO: 3133 - protein, 1149 aa, Agaricus bisporus
  source: /note="var. bisporus"
  source: /note="strain H97 / ATCC MYA-4626 / FGSC 10389"
MNCDHHPSSSSYAELNHGAGAKWSKGLARQRLDNFLGGHFSDVNLSSVLFTHRLDGPDFVKLKVWSAPGLSKPSFEEAMKQKFRTVKKTNHWWKVSVTIPEYFKQYERVQFEFDPGCEAMIYTVDGIPLQGITGGFGGDRRVEYIIPQEAREQCYHEFVVESSCNGMFGVPWNGDTIQPPDMNRFFTLASADLVVPNQEAWRLLWDFQTLKELIDTLPGNTPLQNKALVVANEIMNLLKRGDVSSVAACRKKAEEIFGEGWESKGAGIYEEGPKNSNIWGIGHCHIDSAWLWPYSVTQQKVARSWSTQVDLMERYPEHRFTCSSAQQYKWLELLYPPLFDRVKEKVLEGKFHTVGGSWVENDSNMPSGEALIRQFLFGQRYFESRFGKRCDTAWLPDSFGLTGSLPQLIRGSGMKYFFTQKLSWNNINVFPHSTFNWVGIDGTQVLCHMTPVETYTAQATVGDINKGLTNHKNLESNDTALLVFGNGDGGGGPLPKMLENLRRIRAVTNTHRELPPVSMGHSVEEFFEDIEESTEAGKALPNWNGELYLEFHRGTYTSHGSIKKGNRHSEILLRDLEHVSTLASLYKSEYAYPKGKIDENWEKVLLNQFHDVLPGSAIGMVYNDAEKLYAEVKASGESLLDDALSVLFPDSLPLGLPKHKYSRSSYSRLIGYNMTFLPRWDIIKIPLQSANSALKAQIMQASDDGKEGYAVMTSGNGSQVGQVRSPSSALHAKLLPTSVYTNGSDHFVLRNSSVQLTISKGRITSLLDVKLNRELIAEGQTGGFVIFEDRPNYWDAWDVEIHHLQTARQLEFSDVTVLTQGPLRASVKAEIRYGQSLVTATISLDAIPATTKANSRSLFNFETVVDWHQRHEFLKFEVPLDIHNPNATYEMQFGYVQRPTHKNTSWDIAKFEVCGHKYADLSEFGYGVAILSESKYGFSCIGNVLRISLLRAATAPDAEQDQGLHQFSFALLPHEGSFYESDVPQAAYLYNSPLRVRVLPNGGDSVMRSLLESPFTLTGARNVILETVKRGEDDDFNASLTEPESGTATVVLRLYEAFGGHGKVQLNISRHLPIAKAFATNFLEDEEQELTIDRNSNGNNGDDDLTAPGCSMSLNFRGFEVKTIKLVIGAPPHTPFSPNTKESVSSTAL

SEQ ID NO: 3134 - protein, 143 aa, Agaricus bisporus
  source: /note="var. bisporus"
  source: /note="strain H97 / ATCC MYA-4626 / FGSC 10389"
MTYTISIRVYQTTPKGFFRPVERTNWKYANGGTWDEVRGEYVLTMGGSGTSGSLRFVSSDTDESFVATFGVHNYKRWCDIVTNLTNEQTALVINQEYYGVPERDQARENQLTSYNVANAKGRRFAIEYTVTEGDNLKANLIIG

SEQ ID NO: 3135 - protein, 172 aa, Agaricus bisporus
  source: /note="var. bisporus"
  source: /note="strain H97 / ATCC MYA-4626 / FGSC 10389"
MFSKLLFALFTMIMTHTAVAQSLWPQSGNFLIVSRTNGNQALAVRDGSTTPGANIIVTDPFSTQTGASVWHYEFDNMLINRRSRLALSVHKFNATSGVSIGTKVVQEQVNTSSTAMVQQWNYFAGSGQIHPSFAGDLCVTAGRQLNGGIATIERCVAGRVEQSWTVTRLPSS

SEQ ID NO: 3136 - protein, 259 aa, Agaricus bisporus
  source: /note="var. bisporus"
  source: /note="strain H97 / ATCC MYA-4626 / FGSC 10389"
MAVGKNNCRTSVSRRVRKVSRRRSSTPSPAKWYDIKAPSIFEVRNVGKTLVNKSVGLKNANDSLRGRVIEVSLGDLNKDEEQSFRKIKLRVDEIQGKNCLTNFHGMDFTSDKLRSLVRKWQTLIEAHIDVKTTDGYLLRLFAIGFTKRRPSQVKKTTYAQTSQVREIRKKMFEIMSREATSCDLKELVQKFVPEAIGREIEKASRSIYPLQNVYIRKAKILKSPKFDVSKLLELHGESTDETGTRVVKEFKEPAPQESV

SEQ ID NO: 3137 - protein, 314 aa, Agaricus bisporus; identical to SEQ ID NO: 599
  source: /note="var. bisporus"
  source: /note="strain H97 / ATCC MYA-4626 / FGSC 10389"

SEQ ID NO: 3138 - protein, 314 aa, Agaricus bisporus
  source: /note="var. bisporus"
  source: /note="strain H97 / ATCC MYA-4626 / FGSC 10389"
MLYQPIEPYETGTIKVSDIHTLYYEISGKKDGNPVVFLHGGPGGGTNASDRTFFNPDKYKIVLLDQRGAGNSTPSACLEENTTWDLVSDIEKLRAKLDIEKWHVFGGSWGSTLSLAYAQSHPDRIKSLVLRGIFTLRKSELRFFYQDGASHIFPDAWDEYLAPIPESEREDLISAYHKRLNSDDEDTRIKAATAWSKWEMWTSKLHVDPVHIAHADDSKFANAFARIENHYFVNGGFMRDGQLLEKQSVDKIRHIPTVIVQGRYDVVCPATTAYALKKVFPEATLHIVPDAGHSAREPGISKLLVEATDKFADL

SEQ ID NO: 3139 - protein, 413 aa, Agaricus bisporus
  source: /note="var. bisporus"
  source: /note="strain H97 / ATCC MYA-4626 / FGSC 10389"
MLLTLVPVVVGLLPFVAQAKVHKLKLQKLAPVSSNPQLEGSWLAEKYGAPAQPQAPLMGAGGTGRRIAHPSQQDDETLLWTQEHQVQGGHGVPLSNFMNAQYFTEIQIGSPPQTFKVILDTGSSNLWVPSVKCTSIACFLHTKYDSGQSSTYKANGSTFEIQYGSGAMEGFVSQDQLQIGDLTIKGQDFAEATKEPGLAFAFGKFDGILGLGYDTISVNHIVPPFYKMIEQNLLDERVFSFRLGSSDEDGGEAVFGGIDESAYKGKMHYVPIRQKAYWEVQLDKISLGGEELELENTGAAIDTGTSLIALPSDMAEMLNTQIGAKKSWNGQYTIDCAKVASLPELTFHFGGRAFPLKGEDYVLNVQGSCISSFTGLDINLPWGSLWIIGDVFLRRYYTVYDLGRDAVGFAESA

SEQ ID NO: 3140 - protein, 530 aa, Agaricus bisporus
  source: /note="var. bisporus"
  source: /note="strain H97 / ATCC MYA-4626 / FGSC 10389"
MSRFVRPSKYRHVFGQLAKKEHGLENVKVTNSAWDTNLISASGKYLSVNWNASGGGAFAILPLISPFHGINGFPHKLPDQLPLARSHSAPVLDTDWSPHNDSIVASGGEDGKAMIWKVEPSQFEGWNTEGWVPEDFDPVLRIDASPRKIGQVLFHPTAAQVLATVSGEYTIKLWDLAAPEDPRITLSGHGDSVQGLAFNTTGTLLATTCRDRKIRMFDPRTGGQAVRVTDGHSGIKGARVVWMGEHDRIATTGFSKMSDRQVSIWETGSLNNLKTMTIDQSSGVTMPFWSDNNILFLAGKGDGNIRYYEYESDNLFALAEYKSSDPQRGVCFLPRRALNVAECEIARAYKVVSSGIEPIAFIVPRKADGFQSDIFPSAPSLEPSLSASEFFSGKLAPANLINLGDGSITSGSQPSASPAPAPAPISSPPVSREPTVSVPAPAPVRAPSPTFAPAQRSASPLPSSSPPHRSTTSDIQMGSGEDTSSPLKEENSRLTTELRDAREKIRNLELQVESLRANARKAAQALQMDI

SEQ ID NO: 3141 - protein, 546 aa, Agaricus bisporus
  source: /note="var. bisporus"
  source: /note="strain H97 / ATCC MYA-4626 / FGSC 10389"
MVKTIAVLDESELQDGQMKEVDFDSGKVLLSRLGDRIQATSAWCTHYGAPLSKGVLVADGRVVCPWHGACFNVCTGDIEDAPALAAIHSFKTHVADGKIHVSAHPENTLKDNMRRYPGLLNEDTSFKKGLIIVGGGAGAFFAVDSLREYGYKLPITILSKEPHAPIDRTKLSKALITDPTGIILRTPADLKIKYGTTLRLGVEVTSIDPKKKTVTIDNADTLTYEKLILAPGGIPRRLPIEGADLENVFTLRGVEDAKKIDAAAQEGKRAVVIGSSFISMELVVAFGKRKLASIDVIGMEEFPFEAVLGKEVGGGQKKYHESQGIKFHMQTKVEKIVPKEDNPKLAGGVVVNGTTIPADFVIMGVGVRPATDFLKGSGIEIEKDGSVRVDEYLRVRTGADTENIYAIGDIATYPAPAGVEKRIEHWDVAGNHGRAAGKHICGKTVPFGTVPIFWSAQGGQLRYCGSSSKIDDVIVQGDPSQNKFIAFHVENGSVVAVSSMQNDPIVTKSSQLLKVGLMPTPEELRAGKDVMSIDISTKDALKNVTS

SEQ ID NO: 3142 - protein, 565 aa, Agaricus bisporus
  source: /note="var. bisporus"
  source: /note="strain H97 / ATCC MYA-4626 / FGSC 10389"
MSYPVKEIQTKPYEGQKPGTSGLRKRVKIFQQEHYTENFVQSIFDSIDAKGSTIVLGGDGRYFSQDAVQIILRIGSANGVSKFIIGKDGIFSTPAASNIIRKYKTTGGILLTASHNPGGPNNDFGIKYNVSNGGPAPENVTNTIFEKTKTISSYRVIDAPPLDLSKIGETTFGPTKVVIIDSVTDYLILLKEIFDFSLIKSFLQQHKNDFKVLFDGLHGVTGPYARAIFVETLGLAESSIQNCVPLPDFGGGHPDPNLTYAHSLVEAVEEGNIQFGAASDGDGDRNMIYGKGAFVTPSDSVAVIAQWADAIPYFKKGGVKGLARSMPTSKAIDLVAQKKGLEYFEVPTGWKFFGNLMDAGRLSICGEESFGTGSDHIREKDGLWAVVAWLNILAAANANSPNKLIGINDLLKEFYSIYGRSFFSRYDYEEVSSEGANSLVANLDQALTSGSLNNTEHVSASTSNKFVISGLYNFEYTDPIDHSVSKNQGHVITFSDGSRVVFRLSGTGSQGATVRMYVERYLAPNAPAEELNKSAAEGLKGLIEVALEVSKLKHYLGRDEPTVIT

SEQ ID NO: 3143 - protein, 574 aa, Agaricus bisporus
  source: /note="var. bisporus"
  source: /note="strain H97 / ATCC MYA-4626 / FGSC 10389"
MRISSAFLWTSLALSWGAYAQSSSVDAYLAAESPIAKAGLLANIGPSGSKSAGAKAGIVIASPSHSDPDYLFTWTRDASLVFAVIIDQYTLGLDTSLRSHIDNFVSSQKIIQQVSNPSGTISTGGLGEPKFNIDETAFTGSWGRPQRDGPALRANALITWSNHLLKQNNASYVTGTLWPIIKLDLDYIKNTWNQSSFDLWEEVSSSSFFTTAVQHRSLRQGAALATAIRETSVVADYTKQADNLLCFMQSYWNTAGYMTANTGGGRTGKDANTVLASIHTFDAAAGCDAATFQPCSDRALANLVAYVNAFRSIYAINSGVPSNIGIATGRYAEDVYFGGNPWYLTTLAVAEQLYDALIVWKNQGSITVTNLSKPFFSLFSSGISTGTFSSSSSTFNTLITGVQNYADSFVNVVAKHTPSGGGLAEQYSRNDGNPLSAFDLTWSYASLLTADGARNGVVPASWGAKGLTVPGTCSGNSGPTAHVTFNVNAETVFGENIFVTGSVGALANWSPDNAIALNADNYPIWSVAIDIPASTNVEYKYIRKFNGGVTWESDPNRRFTSPASGSSTLNDVWR

SEQ ID NO: 3144 - protein, 609 aa, Agaricus bisporus
  source: /note="var. bisporus"
  source: /note="strain H97 / ATCC MYA-4626 / FGSC 10389"
MVESAKTYDIIFAGGGAVACIIAARLAVADPSLKILVLEAGPHSRNNQDHEQPARYYPTLVRCGETFTPHVPKANPKLNGRLASTVTGRCLGGGSTVNFTVYCRAAASDYDDWEAVYGNKGWGSKSLIPLLRKAETYQGVTTNDTHGKAGPLKVSFAKADHNLANEWLGVTAAFDQDRGQIDDLNALYACDGYGRWARFINGKTGKRSDTASAYIYPILDTHKNLDVQVRKRVVRVIFEGKRAVGVEYVDDEGDHAHALQSPSVARASRLVVLCAGAFGSPAILERSGIGSTNILSKNDVQQIVDLPGVGEHLMDHNGIFPHYLAADYGDTLDDIWWGSEAEIKPLVDRWSKTGQGLLAHNGMDAGIRLRPTVDDLKEIGPSFTKRWNEYFANAPDKPIMLMAIITGHLGAAPTVPRQKLYNVCSYTAYPMSKGYAHITSGVNPYAVLDYDPCYLHEEADLHVLRWAYKHSREIARRMPAYRGELVTSHPKFPEGSEAAAKASNRPVPIDAPKIKYTEADDRAIDEHVKNIMSSTWHSCGTCAMKPREQGGVVDDRLNVYGVEGLKVADMSIIPGNVSANTYNTAIAIGEKAAVIIAQEFGIKGVAESD

SEQ ID NO: 3145 - protein, 614 aa, Agaricus bisporus
  source: /note="var. bisporus"
  source: /note="strain H97 / ATCC MYA-4626 / FGSC 10389"
MDAKKGMHPVNTTLRLQNIRRLMREGDASVDAYVVPSEDQHSSEYLAECDSRRAYISGFNGSAGCAIVTLTEAYLFTDGRYFLQAEKQLDSNWTLMKQGLPDVPTWQEFLYKKLPKNSKIGVDATLIAAQDAESLHKHLEPNGSKLVSVTKNLVDEVWSDRPARRLNPVIHLDEKYSGQSSADKIAKVREEMKKKKAKAMVVTMLDEVAWLFNLRGSDIDFNPVFFSYAVVTENKVSLFVNANQLDQGAHKYLDGVTDLHPYEEFLPTLNELAGGLQLDKENPIWVGDRASLAVTEAIGKDCYLIARSPLNDLKAIKNATELEGFRQSHIRDGVALARYFAWLEEQLENGVVLNESQGADQLRNFRSELDLFKGLSFETISSTGPNGAVIHYSPDPEDCAVIRKDQIYLCDSGGQYLDGTTDVTRTWHFGTPTKAEKNAFTRVLQGHIAIDTAVFPTGTTGFVIDSWARRHLWQDGLDYRHGTGHGVGHFLNVHEGPHGVGVRIAYNAVPLKAGMTLSNEPGYYEDGQYGVRLENIVLVKDVKLANNFANKGFLGFESVTMCPMHKKLMDMELLNVNEKKWVDNYHAQVWEKVSPLLKHDKRALEWLRRETAPL

SEQ ID NO: 3146 - protein, 993 aa, Agaricus bisporus
  source: /note="var. bisporus"
  source: /note="strain H97 / ATCC MYA-4626 / FGSC 10389"
MSNVEKEPGPQGTTPPEPEPQQPVKRKREYKDFGEDEEKPTHANVDMSTIELKAEDLYDKEKVDLETIVIEDVFKLLQCDENGLSPEEAVRRIELFGPNKLEQDEQNAFLQFLSFMWNPLSWVMEAAAVVAIILSNGEHRAPDWEDFVGIVLLLFINSAIGFYEERNAGNAVKALMDSLAPKAKVKRSGSWSEIESSDLVPGDMVAFKIGDIVPADCRLTEAINVSIDQAALTGESLPQAKKAGDQCFSGSTCKQGEAEGVVIATGSNTFFGRAASLVGQDDDTTGHLQKILAQIGAFCLVTIGIFVIAEIFTLYAGFRFAYRRGLDNILVLLIGGIPIAMPTVLSVTLAVGAQQLAKYKAIVTRITAIEELAGVTILCSDKTGTLTTNKLTIDRNTIRTYGPFSADDVVLLSAYASRTENQDAIDASVISALGDPSRARAGIKLLDFKPFNPVDKRTEITYLEESTGKLKRVTKGMTGIIIELCSRNKTDDVENKLEADVEEYASRGLRALAVAYEELDGDNPEAEGNGFELIGLLAIFDPPRTDTKQTIDDALALGVKVKMVTGDQLAIAKETGRRLGLGDHMYPAKVLKDGPAAGGRHASLDDMILDADGFAGVFPEHKYEIVKRLQGLGHLCAMTGDGANDAPALSRANVGIAVEGATDAARGAADIVLTEPGLSTIVHAIRQSRIIFQRMRNYSIYACAVTIRIVVCFAILAFAYRMDFPPFMILIIALLNDGTIMTLSVDRVLPSMHPDSWDLIEIFSFAIAYGLYLTGSTVALVNIIMETTFFQDRFGVRFTNNAYYPANANDPQVHMIVYLQVAIISQALIFITRSHGFFFMERPSVALLAAFCIAQLVSSIIAAYADWGFSAIEPISGGWIGIVWVWNIVWFIPLDWIKFAMKATVIKSIRRRRENKLAKEAAHGVPLTLTTSRATSMHESLYSNRVNFIKRAARRVGLGGKVSVQPEELQRFSSIQAQRVGATLARNPSRTPA

SEQ ID NO: 3147 - protein, 108 aa, Agaricus bisporus
  source: /note="var. bisporus"
  source: /note="strain H97 / ATCC MYA-4626 / FGSC 10389"
MYVECEIVSNLICDARSQLSTDEQKAIVAGLSDPNQVQASGIRAGGQKFLTIRADPERIYGKKQADGIIIVKTAQTVIVVEYAAPVQAPEATAHVEKYAQDHLISKGY

SEQ ID NO: 3148 - protein, 113 aa, Agaricus bisporus
  source: /note="var. bisporus"
  source: /note="strain H97 / ATCC MYA-4626 / FGSC 10389"
QPKAAASKTPAVKHKFVIDYSKPAADGVFDGADFEKFLHDRIKVEGKAGQLGDHVKITRDGNTKITVTSNIPFSKRYLKYLTKKFLKKNTLRDWIRVVASSKDNYQLRFYNIA

SEQ ID NO: 3149 - protein, 130 aa, Agaricus bisporus; identical to SEQ ID NO: 541
  source: /note="var. bisporus"
  source: /note="strain H97 / ATCC MYA-4626 / FGSC 10389"

SEQ ID NO: 3150 - protein, 142 aa, Agaricus bisporus; identical to SEQ ID NO: 543
  source: /note="var. bisporus"
  source: /note="strain H97 / ATCC MYA-4626 / FGSC 10389"

SEQ ID NO: 3151 - protein, 161 aa, Agaricus bisporus
  source: /note="var. bisporus"
  source: /note="strain H97 / ATCC MYA-4626 / FGSC 10389"
MSQAVPSEISPLAQLPPICSKLLEAKARKGLTFDQVAKVIGKDEVWVAAAFYAQAKFTADELRKVSEALDLPSAQALSEIGDHWWPNRGIGPTPPTDPVLYRLYEAVLVYGTPIKAVIHEKFGDGIMSMIDCKINVDRKADPKGDRVVLTIDGKFLPYARW

SEQ ID NO: 3152 - protein, 170 aa, Agaricus bisporus
  source: /note="var. bisporus"
  source: /note="strain H97 / ATCC MYA-4626 / FGSC 10389"
MGIQEFQVIGRHLPTESDPNPKIYRMRIFAPNEVVAKSRFWYFLRQLSKVKKASGEIIGVNVILEKRPLRVKNFGIWLRYDSRSGTHNMYKEFRELSRADAVKSLYQDMAARHRARFRSIHILRVVEVEKADDIRRPYIKQLLTPNLKFPLPHRIRKARSTFVAKRPSTF

SEQ ID NO: 3153 - protein, 189 aa, Agaricus bisporus
  source: /note="var. bisporus"
  source: /note="strain H97 / ATCC MYA-4626 / FGSC 10389"
MVRYAAAALATNPEKTAKARGEYLRTHFKNMREVAAALTGQKLTKAYAYLSDVKDHKRVIPFRHFSGGVGRTGQAKEFKTTQGRWPEKSIKFITRLLKNAESNAEFKNIDVDDLFIKNIVVQQAPKTRRRTYRAHGRINPYQGHPAHVEIILAASETEVEKATDKVVPSGLGGLNRRQVARKRIEAGRA

SEQ ID NO: 3154 - protein, 203 aa, Agaricus bisporus
  source: /note="var. bisporus"
  source: /note="strain H97 / ATCC MYA-4626 / FGSC 10389"
MATVTTLPKDISKLGQEIKLFGKWDTQDVDVKDISLADYIQVRHAVYLPHTAGRYAKKQFKKAQMPIVERLVDSLMMKGRNNGKKLLAVRIVAHAFEIIHLLTDQNPIQVLVDAIVNTGPREDSTRIGSQGTVRRQAVDVSPLRRVNQAISLLTVGTRESAFRNVKSIAECLADELINAAKGSSNSYAIKKKDELERVAKSNR

SEQ ID NO: 3155 - protein, 228 aa, Agaricus bisporus
  source: /note="var. bisporus"
  source: /note="strain H97 / ATCC MYA-4626 / FGSC 10389"
MSQPPILLYTSTTPNGYPISMHLDELKAVYSTFGGYEYEIQICGQGLRHLDERSKEDWFIKLNPNGRIPTIVDRSRNNFSVFETSAILLYLSQHYDPDFKFWFDPIKDADNYSEMLQWIFFAHGGIGPMQGQAHHFAMRAPEDIPYAKNRYIDETKRLYNVLEIRLKERDYLAGSGRGKYSLADLKTFPWVRIHAKAITPTLDEFPNVKAWVQRIEERPATVTGVKVG

SEQ ID NO: 3156 - protein, 244 aa, Agaricus bisporus
  source: /note="var. bisporus"
  source: /note="strain H97 / ATCC MYA-4626 / FGSC 10389"
MITFYDLTKKSPQTTWSPNPFKTRFSLNYKKLPYNIVNLEYLELEPEFKKVGIPASSTWADGRPLYSSPSIFDSSTNTGVADSYQIAQYLDKTYPDTPKLFPPGTEALQAAFYARFSELLGPFFPFLLPKVPGLLNPESAEYFNRTRAVRFGKPLADLEPKGQDRVEAWKNVEAAYNTLYGWLSQSKGPFFMGDTITFADFAVGGMIYATEVCIGKDSKEFKDLMTWNNGRWAEFRKSLEQYAK

SEQ ID NO: 3157 - protein, 265 aa, Agaricus bisporus
  source: /note="var. bisporus"
  source: /note="strain H97 / ATCC MYA-4626 / FGSC 10389"
MCFPSKRQKNNFADKSTDPKSVSDTNTKGEAKATEPVQAPEPIQAPEPTSSDPVSTFTLHSSTTMPRVAIVIYSMYGHIATMAEAVKAGIVKAGGKVDIYQVPETLSNEILVKMKAPAKPSYPVIQPEGLTEYDAFLFGIPTRYGTMPAQWKAFWDATGGLWAAGKLAGKYAGIFVSTGTQNGGQETTALTTLTTLTHHGIIFVPFGYSHAFAEFSSFETVRGGSPWGAGTYAGHDGSRSPVPLELTIAEKHGKSFWEIVSKVNF

SEQ ID NO: 3158 - protein, 246 aa, Agaricus bisporus; identical to SEQ ID NO: 507
  source: /note="var. bisporus"
  source: /note="strain H97 / ATCC MYA-4626 / FGSC 10389"

SEQ ID NO: 3159 - protein, 263 aa, Agaricus bisporus
  source: /note="var. bisporus"
  source: /note="strain H97 / ATCC MYA-4626 / FGSC 10389"
MSRTSYDRFLTVFSPEGRLYQVEYAFKAISGSGHTAIAIRGKDTAVVITQRKVPDKLLDASTVTHLFSITPTIGCVMTGLIADAHAQVARARSEAADFRYKFGYEITPDALARRIANINQVYTQRAAMRPLGISMILIGVDPEFGPQCFRLDPAGYFVGYHATAAGQKQQEAMNQLEKKWKKLDSGRGADEPAKAGQTLSRSEVIEMAIEIMSTVHATDYKPGEIEVGIVSAGEEEDLKTRGQWRVMGEAEIERHLLAYAEKD

SEQ ID NO: 3160 - protein, 289 aa, Agaricus bisporus
  source: /note="var. bisporus"
  source: /note="strain H97 / ATCC MYA-4626 / FGSC 10389"
MSDNSQGVAAALSGANPARTVLSSFLLCDRVALVTGAQRGIGLEMSLALAEAGAIVYCLDLPANADADWLKVQEYVTKLPDIAPGVNNKGRLEYVSGDVTDQQKMWDIAEDIVKKEGRLDICVANAGILRGFECLEYPAEEFRKLLDVNINGVLFTAQAAGRQMEKLDLPGSIIITASMSGSIANYGQHWVAYNTSKSAVIQMARSMACELGPKKIRVNTISPGYIYTQMTKDFLDPRPELKQQWSLQNPLHRIGRPDELRGATLWLASDASTYCTGSDIIVDGGHRAW

SEQ ID NO: 3161 - protein, 301 aa, Agaricus bisporus
  source: /note="var. bisporus"
  source: /note="strain H97 / ATCC MYA-4626 / FGSC 10389"
MPIATLPIPNSVRVALMVCDELPSHSNHGSMFERYRMWLQRSLPPNSKFILKMIAYDVRKQDYPTAEELRKFFDVVVVTASRADAAGQDSWIRRLTCFVQHVHNKSPHIRIYGNGFGHEIIGRALGGVVTDNGRWEYGWKPIKLTEFGKMVFGAKPFGLQQIHRDHVALDTLSDHFSSGSILLLGSTAKTANQGFVKVYQYCEECEFQGRIHGVHQHIHVMTVQGHPELTDFVVTKVVHHLAEEGILKEEAAKKYTGSESAEEPVSDENMPRLKWPGDDDGISVVGKAFWKMFGVKYHDDM

SEQ ID NO: 3162 - protein, 308 aa, Agaricus bisporus; identical to SEQ ID NO: 601
  source: /note="var. bisporus"
  source: /note="strain H97 / ATCC MYA-4626 / FGSC 10389"

SEQ ID NO: 3163 - protein, 323 aa, Agaricus bisporus
  source: /note="var. bisporus"
  source: /note="strain H97 / ATCC MYA-4626 / FGSC 10389"
MTTSLDQLKQTGTVVVSDSGDFESIDVYKPQDATTNPSLILAAANKPGYARLIDAATKYAKDKGGDLDAQVNNAMDRLLVEFGKEILMIIPGRVSTEVDARLSFDKEATKAKAKQLIALYESVGVSRDRVLVKMASTWEGIQAARELEKEDGIHCNLTLLFGFGQAVACAEAGVTLISPFVGRILDWYKKSTGKNYEGDEDPGVQSVKKIFSYYKQHGYKTIVMGASFRNVGEIKALAGVDFLTISPALLEELKNSTAPVPKKLDSTAKQVSIPKVSFVNNEAEFRWALLQEQMAFDKLHEGIKKFAEDGETLKEVLRKKLSA

SEQ ID NO: 3164 - protein, 344 aa, Agaricus bisporus
  source: /note="var. bisporus"
  source: /note="strain H97 / ATCC MYA-4626 / FGSC 10389"
MPQGSMKALWYSAPKQFDIRDVPIPKVGDDDVLLKVSVCGICGTDAHIDEGEFMAKFPLIPGHEAVGTVVEMGKNVKGFAIGDRCVADVGITCDTCFYCRRGNSLLCENFRACGVAEDGGFAEYIVYQQKKLYKIKNLTDEEATLLEPAACAVHGLDKLNPGVGIEVLLMGAGPTGLILAQLLKQNGASRIVIAANKGIKMDIAKNLNAADEYIELDRQNPGAQWQKLKDDNPYGFDVVVEATGVEKLANESINYVRRGGTLMIYGVYENKALVHWPPSKIFGDEIRIIGSFSQTYCFPRAVAYLDSGKINVKGMVTDIFKLEDYRLALEKMSSRGALKIAIKP

SEQ ID NO: 3165 - protein, 392 aa, Agaricus bisporus
  source: /note="var. bisporus"
  source: /note="strain H97 / ATCC MYA-4626 / FGSC 10389"
MSETPGEAVPAAQRGSWSSFLKSIASFSGDLSSLTAPPFILSPTSLTEFPAYWCERPDLFSAIADAKDPQARALAILRWFISTLKDQYTSRNELMGSEKKPLNPALGELFYAHWPDRNGRGQINLLVEQVSHHPPVTAYVIENKVKGVQLVGHNAQKTSFSSGSIIVKQIGHAVLTVGKEEYVITLPKLRIDGLWYGSPYVELTDTTYIIGGGFMSTIEYKGKGYFTGKSHTFKATVAPLPGMGGSSQEHVVEGLWHEKSKFTKGPFNGDVFHDVETTSKENATVIGGEADGSQGAFETRKLWNLVAKGIREGDYELASREKSRIENDQRQRRKDEAAAGTKWELKHFKHEDSDPLYERLGRLAKITPSEEDFYGFLVNWPEALTKPAGNDK

SEQ ID NO: 3166 - protein, 418 aa, Agaricus bisporus
  source: /note="var. bisporus"
  source: /note="strain H97 / ATCC MYA-4626 / FGSC 10389"
MDNNVPVLLQLPGENPSLKLEILPRGLTIHRLLVQDNGRENDIVIGPEKPEGHITQKYTNSIVGRYANRVPVGKHILNRNGIQSEFEAKANENPQVSLHGGPTGFDSVVWTVLGTEEKPLLFSNTEIERIHALPAKTFALFRLISPDGDQGYPGELLTEVLMALVPSTSGHSSITKLGHVVIAYRSKLADGKAGVTPVNLTQHWGFNMNASLSDRLGTEIATIKDHVIRIEADDIAKRDKLSLPTGDYTPVSSAPVYDFRKSKEIGKDFPEGGYDDYFRLNSSAIYPTPKHIRLSDLETWNSLDAILAQAPLNAASAVQLASEKTRIALDFFSNQRGLMFYTNDLADPAKGARKLIHGGSGISGHGDAYGPGTAVFLEFHDPLAAFLQPENRDADDTMITSEELYNNFVRLEIGFMNA

SEQ ID NO: 3167 - protein, 492 aa, Agaricus bisporus
  source: /note="var. bisporus"
  source: /note="strain H97 / ATCC MYA-4626 / FGSC 10389"
MTRIIVSLLAVSAALASPLSTAHNDFSSRSSLSLAPLVDEFHPHGTVNNSYIVIFKNDVPFDLIANHMSFLHDAHAEDPLVDDFAGVRQVYDGHLNGYAGRFTRNVVDRLRTMPEVAYIEKDQIVHTTEHVTQTGAPWGLARVSHRPELTFSTFTKYVYDSQAGQGVDAYVIDTGINVQHEEFEGRATWGKTVPQDEDEDGNGHGTHCAGTIASRKYGIAKHANVIAVKVLGSNGSGTMSDVVSGVVWAAREAKAKAVAAAKEFAATGKTKHKGSVANMSLGGGKSPALDDAVNGAVDTGLHFAVAAGNENRDACSSSPASAEKAITVGASTLGDARAYFSNYGPCVDVFGPGLNIKSTYKGGRSATAILSGTSMASPHTAGVLAYLLSIYPSKEFNPIFEKDELVSITSPVSQTSFSGIYAITHAALPQWISSFLPAPEFVDFITPIPGHPPTLTPTQLKKALIALSTPDMLDDLPANTVNLLLFNNATHS

SEQ ID NO: 3168 - protein, 505 aa, Agaricus bisporus
  source: /note="var. bisporus"
  source: /note="strain H97 / ATCC MYA-4626 / FGSC 10389"
MAHIATITIAATNKQIPVPTGLFINNEFVPSVEDSPEKILAINPATEEVICPVVSASPRDIDVAVKAARQAFQTTWGKNVTGFERSRLINKLADLIERDQQELAELETLNNGKPVKIARDFDIGDTIQCLRYYAGWADKIIGQSLEVDNKTKLAFTRNDPIGVCGQIIPWNYPINMWAWKVAPALAVGCTIVMKPSELTPLTALKLSELVREAGFPPGVVNTVPSYGHVGGAALAAHPDVDKVAFTGSTVTGRKIMEAAAKSNLKKVSLELGGKSPHLIFESADLEQAASWAALGICYNTGQDCTAGSRVYVQEPIYDRFIDLLTAKVKATIMGDGFDEISTGGPIISKGQYDRVWAYIEAGKQEGAKPILGGVKRTGKGFFVDPTIFTDIHRDMKIVKEEIFGPVLSVGKFKTEDEAISLANETNYGLGAGVHSSDANQCMRVSSSLEAGTVWVNQYNLLSNNVPFGGKKQSGIGRELGSHALAEYTSVKAVHWNFGEKVDWPL

SEQ ID NO: 3169 - protein, 539 aa, Agaricus bisporus
  source: /note="var. bisporus"
  source: /note="strain H97 / ATCC MYA-4626 / FGSC 10389"
MLTSRGAVARLSKRAFNSARQTNALFSSAALPRVALPAQSQQTAGLSRPQASSSNIPARSYATESKAIVGSVKTVIGAVVDVQFDTDNLPPILNALEVQDFHGGRLVLEVASHLGENSVRTIAMDGTEGLVRGTKVIDTGAPIQIPVGKATLGRIMNVIGEPIDERGPIKGVKLSPIHAEPPAFVDQATTAEVLETGIKVVDLLAPYARGGKIGLFGGAGVGKTVLIQELINNVAKAHGGFSIFCGVGERTREGNDLYHEMIETGVINLEGDSKVALVFGQMNEPPGARARVALTGLTIAEYFRDEEGQDVLLFIDNIFRFTQAGSEVSALLGRIPSAVGYQPTLSTDMGGMQERITTTKKGSITSVQAVYVPADDLTDPAPATTFAHLDATTVLSRGIAELGIYPAVDPLDSKSRMLDPRIVGKEHYEVATAVQKILQDYKSLQDIIAILGMDELSEEDKLTVERARKIQRFMSQPFQVAQVFTGYEGKLVPLKDTVRSFKEILAGTHDGLPESAFYMAGTIEDVKSKAEQLAKDMGN

SEQ ID NO: 3170 - protein, 519 aa, Agaricus bisporus
  source: /note="var. bisporus"
  source: /note="strain H97 / ATCC MYA-4626 / FGSC 10389"
MSSPAKPVYTTSNGAPVNEPYSAQRAGFHGPLLLQDFHHIDLLAHFDRERIPERVVHAKAAGAHGYFQVTHDLSDITSQSLFQGVGKKVRITARFSTVGGESGSADTARDPRGFAIKLRTEEGNWDWVFNNTPIFFIRDPAKFAHFIHTQKRNPQTHLKDPDAFWDYLGQNPESIHQMMILFSDRGTPDGFYQEHGYSGHTFKWCKADGSFVYVQVTCRADGGFKTLDDATATRLSGENPDYGTQQMFEAIEAGNFPSWTVYIQTMTPAQAEQFRYNILDLTKVWPHKEFPLRPIGKMVLNENPQNYFAEIEQVAFSPSHLVPYIEPSADPVLQSRLFSYPDTHRHRLGANYQQLPVNAPIVPVANFQRDGPMAFVNQGNRPNYQCSFQPLTYAGRPGHMDASVNDRERDARHENFINGAWRYLSVISELDFEQPRELWSRVWNDQERETYVKNVSGHFKNVKSAEVKARQLSVWAAVDQGLSDRIADAVGHPHVAPLKCISAAEVLNFRHNIGAGSNQ

SEQ ID NO: 3171 - protein, 734 aa, Agaricus bisporus
  source: /note="var. bisporus"
  source: /note="strain H97 / ATCC MYA-4626 / FGSC 10389"
MADQQPQPHILLVDSYCSFAYSLAALCKKAIPHSVLHVIKNDTHTIRDLLPVIRQFSAIVVGPGPGSPDIPTDIGVVRDLWKVADENLVPTFGVCLGQQSLGIEYGATIHRLHTVKHGQVSVVQHTGTEFFAGLPDLKVVRYHSLHIRPHAGGDIEELAWSEDEENGRVVMGVRHITKPFWAVQYHPESVLTDEGGLKVLENFWTLAHAWNQTNRPSFTPPVEIILPQSHIWPRISQRYSAHEFNKSLGSVTYKTIQVPDISIIDLCEYLGVHDESKRFVFLDSAAYPGQHSILACLGDASSQFTHYVHENFVEITTGTLTVQQELSGKDIWTWLDEYRESRKVAGGDARVPFWGGFAGYLTYEAGFGALDIPVPRKSNHRENNHPDVNLVWVDRSIVVDTATSKIWVQSLLPEDEQWIRETAVHIAGLPRASTIPNMPSADQVTVKFPDHDQYIEDIKRSKEYLFSGDSYELCLTGQTQICVPKEAVMPAWERYKLLRTVNAAPHAGYLRLHPTTFLSCSPERFLSYSRTPGAVCQLRPIKGTVRKLPHITREVAEEMLAGSRKEIAENLMIVDLIRHDLHNAVGERVSTKKFCGVEEYETLWQLVSVIEGSLSEGTSIEVDDSLGWEVLRRSLPPGSMTGAPKKRSVELLQGIEGRERGPYSGVFGYWCAGGGGDWSVTIRSCFLHDSEKGDGEEWTIGAGGAITALSDPDAEWEETKVKLNGVLRGFGASC

SEQ ID NO: 3172 - protein, 759 aa, Agaricus bisporus
  source: /note="var. bisporus"
  source: /note="strain H97 / ATCC MYA-4626 / FGSC 10389"
MAPLSHPSIVDGWFREISSQWPGQAMTLKVNKILHVEKSLYQDVLVFESETFGNVLVLDGVIQCTERDEFSYQEMIAHLPLASHPNPKKVLVVGGGDGGVVREVLKHDTVEQVVLCDIDEAVIRVSKQYLPHMSSLLSDSRVTVHIGDGFKFLSNNQNTYDVIITDSSDPVGPAESLFQKPYFELLHNALTPGGHISTQGECQWIQLSLIQDLKRVTSEIFQTTEYAYTTIPTYPSGQIGFMVCAKAPGRDLRTSIREVKNTKYYNKDIHRTAFVLPEFTRSVLEEGKDIRPKFGRAAKAVEAEAAGRKKKRVLLLGSGFVARPCAEYVVRNPENELTIACRTLSSAKALAESLPATTAISLDVNSTDALEKAIAEHDLVISLIPYTYHAAVIRAAIKSKTHVVTTSYVNPLMRELDAEAKAAGIVVFNEIGLDPGIDHLYAVKTINEVHAKGGKIKQFLSFCGGLPAPECADNPLGYKFSWSSRGVLLALLNTASYISNSQAITVTGAELMGHAKPYYISPAFAFVGYPNRDSTPFREWYHIPEAETVLRGTLRYQGFPEFIGTLVKLGWLDQTEKEWLKEGITWKQITKNLVGAKAQDDLTEAAIVDRINAKVQFSSASEAERIVSGLRWIGTLSDEPAQIRAGNLLDTLCARLEGLMKYEVGERDLVMLQHKFVVEWADGTTQILTSTLEAYGSTVPGGYSAMALTVGVPCGITVQLVLDGVLKEPGVHAPYDYEVCEKIRKVLEIEGLGMVEKVM

SEQ ID NO: 3173 - protein, 3931 aa, Agaricus bisporus
  source: /note="var. bisporus"
  source: /note="strain H97 / ATCC MYA-4626 / FGSC 10389"
MAVPNGHAVPHAIASRPLIVAQGRVRISVPVSTKTDEWIAAEVLRDEFIHAQSLDAADASSVIEDESEATVDLAAKFLAHVASNIDNDSQSTEARIRLLLNVLKHFTSSYLATKDIHSLCASYSIDTRKTVLSAYYRAVAALENKDSSSIPRQPESALLDAAKSGKASIFALFGGQGTNEVYFNELQSLYDIYQPYVTPFLESVLPDLIGLAEDEVDSSYYTHGLDVVSWLSDATKRPSIAYLASAPLSLPLIGLTQLIQYLVVCRVANLTPGQVRSRIAGATGHSQGILSAVVISASETFDDFTENSRKALRWLFYCGLRGQQAFPPVAVEPSLVQDTLDGGEGTPSPMLSVAGLPLKDLEVHIKKTNSHLPANSQLGVSLYNGPRAFVVTGPARALHGLVTNLRKVRAPSGADQSKVPFSQRKPVFSVRFLVVGVPYHSPYLKGVTDAVMDEDLEELWEPSDLKIPVYNTETGEDMRNMTGSITRSLCDQIYTAPIHWTKATDFPETATHAIDFGPGGLSGVGPLSARNFDGRGIRVILVGDSGKGDAELYDSLSVKYEDWWSKKFAPSLVRTSDGTIHLDTPMSRLLGKPPIMVAGMTPTTVKAGFVSAILNAGYHVELAGGGHYNAKDLRAKVAEIQSKLPSGVGLTLNALYINPRQFTFQFPLWQELRREGAPVEGFCVAAGVPTTEKANEIIEGLRTAGIKHIAFKPGSVDGLRQVVNIAASNPDFPIICQWTGGRGGGHHSYEDFHQPILSTYRSLRSHSNIVLVAGSGFGDAEDIWPYLTGDWSERFGVQRMPFDGFLFASRVMVAKEAHTSSSVKDLIVAAAGVEDEQWEGTYTKPTGGVLTVRSELGEPIHKVANRAVRLWKEFDNTVFSLPKEKRAAWLSERRDEIIEKLNKDFAKPWFGEKKDGSVAKELGDMTYEETVLRLVRLMYVSKQKRWIDRSLRNLTGDWLRRVEERFAGVNTTGNKPSLLQSYASLDDPSAFVESFFEAYPLATEQLLAADDVAYFLAISQRPGQKPVPFIPVLDVSFEVWFKKDSLWAAEDIDAVFDQDPERVAILQGPVSAKGSLVKDEPIKELLGNINSSLISKLLESRYGGDESSIPTIDYLAAEPFVPATLSNVARYERGSDVVYQFGSSLPSTEDWLAALGGSELNWLHALVTSETIVQGTSYIDNPIRRLLAPRPKQRIVVGYENSLPVSITAYGAARSYGAHIPGFKAVEIKFNQSSQLIDITMFEERRDVAVPLKLQFHYQPEQGYMPIHEIVDGRNQRIKDFYWKLWYGDNEVLPNVDIKEKLVGPEVTITAEEVEEFCAVVGNQGESFKNVRNDSVQAPMDFAIVTGWQAIMRSIFPADIDGDLLKLVHLSNGFKMVEGASPLKVGDICKSEARIVSVVNAPEGKTVTVKGHVYRDDQPVIEVVSSFLYRGRFTDYENTFETTEEPDYLVPLETDAEVGVLQSKQWFGWENESTPLLAGTALIFRIQSSVFFKDRGVFRNVSVSGDVFVRNQLKVLVKVGNVDFQQDDCQGNPVLSYLQRHGTPQGLPTPLANEGYTLRHVEGSTIFNAPLTNEPYSKISGDFNPIHVNPYFSDYASLPTTITHGMWSSAATRRYVENVVAQGHPDRVLAYNVSFVGMVLPNDELEVKLKHTCMRDGNIVVAIETTNSRGEKVLVGTAEVKQPTTVYVFTGQGSQEPGMGMDLYNNSPAARAVWDGADAHLLATYGFSISEIVRDNPKEKTIYFGGIQGQAIRQRYMDMTYDTLDKDGNTKTLPLFADIDNRTPRYTFSHPNGLLFATQFAQIALVVTEKSAFEDMRAKGFVQKDCAFAGHSLGEYSALASIADVLHISALVDVVFYRGITMQRAVERDSENRSNYAMCAVNPSRISKTFSDAALREVVDMIAVKTGSLLEIVNFNVEGQQYVCAGELVALQTMTNVLNYLKVKKVDIAQLTKQFPIEKVKQMLGDIITECNQRALDQQKSQGYIILERGFATIPLPGIDVPFHSRYLWAGVLPFRAYLSKKINPATLNPDMLVGKYIPNLIAKPFAVSREYAQIIYDQTSSPRLDKVLQKWEEDNWDSSENRQMLAYIILVELLAYQFASPVRWIQTQDLLFTQYKFERLIELGPSPTLTGMASRTLKAKFESSDDSVSCTRVILCHAKNTKEVYYQYEDEPEAPAEAAPDAPAPATAVASAAPVAVAAVAVAAAGPAASIEDAPIKAIDILLVIVAQKLKKRVDEVPLSKSIKDLVGGKSTLQNEILGDLQQEFASAPEKGEELSLEELGSALSTGFSGALGKYTTSLVARLVGGKMPGGFNASAIRSYLNKTWGLGPSRADGVLLLATTLEPPKRIASEAEAKTWLDGVVQTYAQRSGISLTAPGAAAGAVGGGGGATINSEEFLKFTADQDKFIQQHIELYNRYLKKDSRAGEIAYDREKVNTLALQAKIDSITREHGDSYLDGIQPRFDPLKARHFDSSWNWVRQDALLMYYDIIFGRLTTVDRDITARCIALLNRADPDMLQYMEYHINKLDPSKGDTYKLAKDFGQQLIDNTRDIIGKSPLYKDVTFPTAPHTEVTAKGDIVYSEIVRENVRKLEAYVEEMATGDGVAGSVNIQKVQDDVLKLWTVVKSLPEINQDQKNRIKSLYEGVVRSLQKGPDPHPRVQSTRSRRSSSQFLRPHNAGVANVTADNIPLLHLKRRVAATWEYSSNLTGVYLDILHEIATSGTTFEGKNALCTGVGKGSIGVEIVKGLLSGGAHVVITTSSYSRKTVEYYQSIFQTVGSRGSALTVVPFNQASKQDVEALVDYIYNNLNMDLDYILPFAGIPENGREIDGLDDRSELAHRMMLVNLLRILGCVKNKKANRRIVTRPTQVILPLSPNHGLFGNDGLYSESKISLETLFQRWASESWGEYLCLAGAVIGWTRGTGLMAPTNIVAHELEGYGVRTFSAKEMAFNILGLMHPLLFSITQVEPIWADLNGGMDRLPDLADITTRIRTNLLKKADLRRAITKDNAADFKVTNGVEAERLLQTIDVLPRANFRFDFPELESAESLSDVTQLRGMIDLEKVVVVTGFAEVGPWGSSRTRWEMEARGELTIEGYIEMAWMMGYIKHFNGRLKDGSLYVGWVDSKSGESVDDKDVKGRYEKDILAHAGIRLIEPEIFRGYDPNRKSFNQEIELIHDLEPIEVSEVEAQKFKLQHGDKCDIWAGEDGQWFAKLKKGACVLVPKAFKFSRTVAGQIPSGWHAGRYGIPEDIIAQTDRCTLWALVCTAEALNSAGITDPYELYKYMHPSEVGTSLGSGMGGATSMAKMFKDRRDEREVQNDILQETFINTTAGWVNLLLMSSSGPVKIPVGACATALQSLEIACDTILSGKAKVMIAGGFDDISEEGSYEFANMKATSNAETEFAMGREPTEMSRPATTSRAGFMEAQGTGVHIVMSAKTALEIGAPIRGILAFTSTSTDKAGRSVPAPGKGALSVAREVPSKHPLQILDVKYRSRQLAFRRTQISQWLDHEHVELQEEITSRKSEGENVDESYVASRVANLEKEAARQEKDAIAMYGMLEGSDPRVAPLRRALAVWGLNADDIGVLSIHGTSTGANEKNETQIWNDIFTTISRSRGNAVPIVAQKSLLGHSKGGSAAWQMAGLLQYVLSGVIPGNRNSDNIDSNFVDRRFLMFPSKTIYTDGIQAGVMSSFGFGQVGGTALVVHPRYLFGALEPSFYEQYKERNRTRALQSYKAMSDMMVKNSLVKIKENPPFTPENEREVLMNSMARVTCDPKTGEYSFKGKLPREAPLDLSNLKLVSDVMTAPSAATNSNIIGVGVDQELITSVPSHNPTFVARNFTEAEIAYCRAQPSPASSFAARWVGKEAVFKSLGVKSAGAAAVLKDIEILNDDAGVPSVRLHGEAQVKAQERGVANVLISLSHSETIAIAFAQASST

SEQ ID NO: 3174 - protein, 124 aa, Agaricus bisporus
  source: /note="var. bisporus"
  source: /note="strain H97 / ATCC MYA-4626 / FGSC 10389"
MSYVAKGEKEYDATGAPVPGAKIHKIRITLTSSNVKNLEKFSGDLINRAKDKQLHVKGPVRLPTKVLKITTRKTPCGEGSKTWDRYELKIHKRLIDLHASSEVVKQITSISLEPGVEVEVTISA

SEQ ID NO: 3175 - protein, 136 aa, Agaricus bisporus
  source: /note="var. bisporus"
  source: /note="strain H97 / ATCC MYA-4626 / FGSC 10389"
MPESNFKRFVEVGRVVLVNDGPLAGKIAVIAEIIDHNRAIIDGPTSGIPRQSFPYKHLLLTPLKLTKLPRAAGTGIVRKLVEQEGIVEKWDKSAWAQKRVMKEKRRSLSDFGRFKVMLAKKQRRDVVRKAVKKASA

SEQ ID NO: 3176 - protein, 147 aa, Agaricus bisporus
  source: /note="var. bisporus"
  source: /note="strain H97 / ATCC MYA-4626 / FGSC 10389"
MASQVNAVQTFGKKKACFTATAVAYAKEGRGLIRINGSPIGLVQPEILRLKVYEPVLVAGEDAFGILDIRVRVKGGGHTSQVYAIRQAIAKALVAYYAKYQDAYSSLELKKKLVAYDRSLLIADPRRMEPKKFGGGGARARRQKSYR

SEQ ID NO: 3177 - protein, 151 aa, Agaricus bisporus
  source: /note="var. bisporus"
  source: /note="strain H97 / ATCC MYA-4626 / FGSC 10389"
MGRMHAPGKGISSSALPYRRTPPSWLKTTSEEVVEQIVKLARKGLTPSQIGVTLRDSHGIPQVRFVTGNKILRILKSQGLGPSIPEDLWHLIKKAVAVRKHMETNRKDKDSKFRLILIESRIHRLARYYKTKQQIPPTFKYDSATASTLIA

SEQ ID NO: 3178 - protein, 165 aa, Agaricus bisporus
  source: /note="var. bisporus"
  source: /note="strain H97 / ATCC MYA-4626 / FGSC 10389"
MAPKFDPNEVKIIYLRATGGEVGASSALAPKIGPLGLSPKKVGEDIAKATSAWKGLRVTVQLTIQNRQAAVSVVPSASSLVIRALKEPPRDRKKEKNIKHSGNVALDEIFDIARTMRDKSLAKELSGTVKEILGTAQSVGCTVDGKPPHDVIEAIDAGEIEVPAQ

SEQ ID NO: 3179 - protein, 155 aa, Agaricus bisporus
  source: /note="var. bisporus"
  source: /note="strain H97 / ATCC MYA-4626 / FGSC 10389"
MADAQIEKAFQKQHLFQNAKARGGKKVVTRQKRWYKDVGLGFKTPSDAINGTYIDKKCPFTGDVSIRGRILTGKVLSTKMTRTIIIRRDYLRYISKYSRYEKRHTNLAAHVSPAFRVELGDTVTVGQCRPLSKTVRFNVLRVSRNKATAKSFGKF

SEQ ID NO: 3180 - protein, 158 aa, Agaricus bisporus
  source: /note="var. bisporus"
  source: /note="strain H97 / ATCC MYA-4626 / FGSC 10389"
MATTKTTKGKAAAKSAASKDNKAKAAKKAALQGAHSHSSRKTRTSVSFHRPKTLRLPREPKYERKSINHAPRMDQYRTIVSPLNTESAMKKIEEHNTLVFIVDVRANKRQIKDAVKKLYDVDAAKVNTLIRPDGKKKAYVRLTADADALDVANKIGFI

SEQ ID NO: 3181 - protein, 160 aa, Agaricus bisporus
  source: /note="var. bisporus"
  source: /note="strain H97 / ATCC MYA-4626 / FGSC 10389"
MPHSFGYRARTRQMFSRSFKEHGMIGLSTYLTNFRIGDIVDIKANAAQQKGMPHKFYHGRTGVIYNVTPSAVGVIVYKVVGNRYIEKRVNIRVEHIKHSKCRQEFLDRVKANHDAHVAARAKEERVDLKRKPAQPREARTVSTANNAPQTMRPVPYETTI

SEQ ID NO: 3182 - protein, 186 aa, Agaricus bisporus
  source: /note="var. bisporus"
  source: /note="strain H97 / ATCC MYA-4626 / FGSC 10389"
MGIDIAKHHVKKGQRTAPKSEDPYLLLLVKLYRFLARRTDSSFNKVILHRLFLSKTNRPPLSLSRIARETSKATDLDSKIIVQVGTVTDDIRLTEVPKLSIAALRFSRAAKERIIKAGGEAITLDQLALRSPLGANTILLRGVKTAREAYKHFGMGPHKHKKPHTISKGRKFEQGRGRRKSRGFKV

SEQ ID NO: 3183 - protein, 218 aa, Agaricus bisporus
  source: /note="var. bisporus"
  source: /note="strain H97 / ATCC MYA-4626 / FGSC 10389"
MSSKLSVSSVRGSVKELLAEANGEKKRKFTETVELQIGLKNYDPQRDKRFSGTVKLPHVPRPRMSICILADAADIDRAKQIDLEYMSVDDLKKLNKNKKLVKKLGKKYDAFLASETLIKQIPRLLGPGLSKAGKFPTPVSHAEDLNNKITEVRSTIKFQLKKVLCLGVAVGHVDMNDDQVLANVMLSINFLVSLLKKNWQNVKSLHIKSTMGKPIRLY

SEQ ID NO: 3184 - protein, 250 aa, Agaricus bisporus; identical to SEQ ID NO: 614
  source: /note="var. bisporus"
  source: /note="strain H97 / ATCC MYA-4626 / FGSC 10389"

SEQ ID NO: 3185 - protein, 287 aa, Agaricus bisporus
  source: /note="var. bisporus"
  source: /note="strain H97 / ATCC MYA-4626 / FGSC 10389"
MPVDRLEDKVVLRHPKGATVEVLYYGATVTSWKVQGVERLFVSANASLDGSKPVRGGIPVVFPCFGAPTHRDHMKLPQHGFARSEEWSFESIVLDNDVGVSVRLTLSPTARIASKFERNFKLAYVVTLAEHQLSTDLHVYNPSESSHDLEFQALFHNYIRAPASSVRIKPLQNLGYYDKTQQTDEGKALRRIESRAEVDVNIFTDSVYENSPGDYQVSWSGGEIDIRTKSLDNVVVWNPQEGGKKIADMEENGWERFVCVEPGYVRGFVKVSPGEKWIGQQTLTIKT

SEQ ID NO: 3186 - protein, 311 aa, Agaricus bisporus
  source: /note="var. bisporus"
  source: /note="strain H97 / ATCC MYA-4626 / FGSC 10389"
MPSLQFLPQPLTAAIVGCPFSGGQRRTGVDQGPIRLVEAGLVEQLKGLGWNVVFDGHHQFEEYNNLDDAPIGIMKNPRTVSQVNRSVAGVVMNHAKNGMLPVTLGGDHSLAMGTISGSLAVHPDACVIWIDAHADINTIETTDSGNMHGMPLSFLLGIGDKIQEFDWIKPVLKPERLVYIGLRDLDAGEKRLLREHNIKAFSMHEVDKYGIGKVVEMALDYVNPKRDLPIHLSFDVDALDPSVAPSTGTPVRGGLTFREGHYICEAIHETGLLVSLDLMEVNPSLAEAADADKTVAVGCSLVRAALGETLL

SEQ ID NO: 3187 - protein, 306 aa, Agaricus bisporus
  source: /note="var. bisporus"
  source: /note="strain H97 / ATCC MYA-4626 / FGSC 10389"
MEAELERMMMGRAAAARGDQTVPDNGEVIHISSLALLKMLKHGRAGVPMEVMGLMLGEFVDEYTVQVIDVFAMPQSGTTVTVESVDHVFQTRMVDMLKQTGRPEMVVGWYHSHPGFGCWLSSVDINTQQSFESLNSRSVAVVIDPIQSVKGKVVIDAFRLINPHTVISGREPRQTTSNIGHINKPSIQALIHGLNRHYYSIAVNYRKTDLEQSMLMNLHKRNWTEGLKLRDFRQHKESNEVAIKSMLTLSEAYNKSVQEESTLSADQLKTRHVGKQDPKRHLEEAVEKAMGDQVVQNLGTMLLAEL

SEQ ID NO: 3188 - protein, 311 aa, Agaricus bisporus
  source: /note="var. bisporus"
  source: /note="strain H97 / ATCC MYA-4626 / FGSC 10389"
MNSFVDQFSTHSPTAQLKRAQKLIAAEDDDYSDASWGSQAGPGGMIKGIPAFKVPAVADPTAFLRLHTDDHADPNCRIKIQHGTTTLAFRFKGGVIVAVDSRATAGSYVASGTVKKVIEINPYLLGTMAGGAADCQFWETYLGMHCRLHELRNRERISVSAASKYLSNLVYSYKGMGLSMGTMICGWDKTGPAVFYVDSDGTRLKGDLFSVGSGSTFAYGVLDQGYRWDLTDEEAQELGRRSIFAAGHRDAMSGNTCNLYHVKEEGWDFIGNYDISKMYYEGPGDVPGAPGGGYGYAIRTEGRSAANPPPS

SEQ ID NO: 3189 - protein, 312 aa, Agaricus bisporus
  source: /note="var. bisporus"
  source: /note="strain H97 / ATCC MYA-4626 / FGSC 10389"
MAANVPKIKFNNGEEIPAVGLGTWQSSADDVKNAVEHALKEGYRHIDCAWGYGNEQHVGEGIRASGVPRSEIFITSKLWSTWHSRVEEALDQTLANLGTDYLDLYLIHWPVPLNPKGNHPAFPLLPDGKRDVDHSWHLKDTWKQMEAVLKKGKVKSIGVSNFSKMKLEEILPSAEIVPAVDQLELHVYNPQHELVKYLKSKGITPQAYSPLGSTKSTLLTDADVVEIANKHNLQPADVLLGYLLAKEMVVLPKSVTPSRITSNLSGAIRALETLTKADVERLDGLAAAGKQNRFITPPWPIELGFDNWPKLL

SEQ ID NO: 3190 - protein, 344 aa, Agaricus bisporus
  source: /note="var. bisporus"
  source: /note="strain H97 / ATCC MYA-4626 / FGSC 10389"
MSYEKALSSFSEEEIIKEQEEITKFLEEPGTVAKFSEACKNIGQTAVSIDENFRIVQKGFATIVEKYGKDFPEVGSVYVPRWNGYMARWNGETGMLWSSRKLAAETAAALTDYGINLGLIADIQSPDDLEGAKLELQQYVEKHPVHIAKTVAEDFENLKTDIQGFSKDFMAYIEEQKQELTEDAERFEAEIKQLQETITKLNVEIVVAVIAIGCSFALGIVEGFLAIGPLLKLIADRIAAQRDLNTAQANLKATIEKQKALAAMQADFENLKPNIDDICTKLGVFADIWTFATDQSAAINTELQEGMEVLTRKKFQTKLHLLMAQIEPLKEGMRQYASQIVPPS

SEQ ID NO: 3191 - protein, 351 aa, Agaricus bisporus
  source: /note="var. bisporus"
  source: /note="strain H97 / ATCC MYA-4626 / FGSC 10389"
MSAPKARASPTSSVSDSHRNVVDHLSPGGVTEDVQPVGPKRTVQGMDKPHMITVQPLKRSEMQPSYAQDLGTGEVVHGVYGSLLQGLGSVLGLCGAVPCMPCPNPFREVNQGSVGLVTRFGQFYKSVDPGLVQVNVCTESLRIVDVKIQISPIGRQMVITRDNVNVEIDSVIYFQITNPYRAAFGITDLRQALIERSQTTLRHVVGARAVQSVVTEREAIAYEIAEIVGDTADKWGVSIEGILIKDIIFSAEISASLSSAAQQKRIGESKVIAARAEVDAARLMRQAADILASPAAMQIRQLEALQHMAKTSNSKVIFVPMQLQNDLANQFTGSSSGSGIKDAVQGEAEIE

SEQ ID NO: 3192 - protein, 348 aa, Agaricus bisporus
  source: /note="var. bisporus"
  source: /note="strain H97 / ATCC MYA-4626 / FGSC 10389"
MPKKPISYVRLGKSGLKISKIILGCMSYGDTRWNKWVIEDEEEVIRHIKVAYDAGIQTFDTANYYSNGASEVLLGKAIKKLNLPHDEIVVMTKLYFVAGREPGVNVSASGLNPDDEGYVNQHGLSRKHIFESVKRSLERLQLDYIDLLQCHRFDSETPIEETMQALHDVVQAGYVRYIGMSSCYAWQFHAMQNYAIANKLTPFISMQNHYSLIYREEEREMMPTLKYFGVGSIPWSPLGRGLLTRPLAQSKETTRSQSDNILPSYGGGEGTNEIVNRVEEVAKKRGISMAQVAVAWTLSKEVVSAPIVGTTSVKNLEDIIAGASVVLTPEEITYLEEPYKPQSIIGNA

SEQ ID NO: 3193 - protein, 358 aa, Agaricus bisporus
  source: /note="var. bisporus"
  source: /note="strain H97 / ATCC MYA-4626 / FGSC 10389"
MGVLDIVPAGVLTGDNVRKLFDYAKANKFAIPAVNVTSTSVANAVLEAARDIKSPIIIQVSQGGAAYFAGKGLANDKQQASIVGAVSAAHHVRLMAKAYGIPVVMHSDHCAHKLLPWFDGMLQADEAYFNDHGEPLFSSHMLDLSEEPKEENIKICEKYFKRMAAIGIWLEMEIGITGGEEDGVDNSNVDNSSLYTQPADVFDVYKALHPISPNFSIAAAFGNVHGVYKPGNVRLRPELLAKHQEYAREQIGSKDSQPLYLVFHGGSGSLAEEIKTAVDNGVVKMNVDTDTQYAYLVGIRDFIEKKKGYLMSQVGNPEGEDKPNKKYYDPRVWVREGEKTLSERVKVACTNLGNVNRL

SEQ ID NO: 3194 - protein, 361 aa, Agaricus bisporus
  source: /note="var. bisporus"
  source: /note="strain H97 / ATCC MYA-4626 / FGSC 10389"
MRLAAGFLLASFLFSGFSNGCPVSSTLSNSVDDVDDRVFVTMPTAALRPASGCFPGFNFKMPESPPASLTGWWCDWDTEYAFVGFSYEVSACQSLHTLKTEFMDIRQRFHGRYVRIYGTCDRKGFNDDVINAAWHAGIGVHALIWFGFDGDNKWKGRRDALFSTLHSNPYAKFVVRVVQFGSEPLFDGVLSSSSLAKEVWRAKSELAKLQIPVTVSDMAYSYQKDRASSHVIDAIDIIDAHILPFFSRDASTAKKSWPLVQQDLNWFLNNGQGKKIYLSQNGWPSKSYPGVEPNSDKAVANVQNEKDYFNLLDAHCSHFKSAPGGGIGWFAHIYSDNQEPGYGIYDTKGRLKFPFSPRVTC

SEQ ID NO: 3195 - protein, 377 aa, Agaricus bisporus
  source: /note="var. bisporus"
  source: /note="strain H97 / ATCC MYA-4626 / FGSC 10389"
MLTTSRSLLGFAQNTLKQGYAVRRYASAAPTAAFAGQKGSNGKYTVTLIPGDGIGPEISQSIKDIYTAANVPIQWEEVSVTPVLKGGKTVIPDTAIQSVKRNTVALKGPLATPIGKGHVSLNLTLRRTFNLFANVRPCVSIKGFKTPYDDVNTVLIRENTEGEYSGIEHEVIDGVVQSIKLITWDASERVARYAFHYAQSSGRKRVTAVHKANIMKMSDGMFLSACREVSKEFPDVAYDEDLLDRVCLQIVTNPRPFSDRVMVMPNLYGDILSDMCAGLIGGLGLTPSGNIGRDASIFEAVHGSAPDIAGKGLANPTALLLSSLMMLRHMNLYEHADRIEKAALSTIAEGKTITGDLGGEATTKEYTSTIIAKLGKA

SEQ ID NO: 3196 - protein, 384 aa, Agaricus bisporus
  source: /note="var. bisporus"
  source: /note="strain H97 / ATCC MYA-4626 / FGSC 10389"
MSVDTSAAQSPTIGVVQDKINVGILGATGTVGQRFITLLSSHPWFKIHALGASSRSAGKPYHSAASWKQTTPIPSSVRELIVHPCDPTEPHFRECTIIFSGLDAEVAGDIEAAFRTAEFAVFSNAKNYRRDPLVPLIVPLVNNPHLAMIPQQQALHNPPLKKGFIVTNANCSTTGYIIPIAALEKSFGPIEAIMVTTLQAISGAGYPGVPSLDIFDNVIPYISGEEEKIEWETLKILGGITENDDGLKVFDMHASHPLRVSASCNRVPVIDGHTECVSVRFARRPPPSPQQVREALAAYTPDAQALGCPSVPRHAITVHEEPDRPQPRLDRYYQEGAGVSVGRVRQCQVLDIKFVVLANNVSIGAATSSIINAELAILRDIVSR

SEQ ID NO: 3197 - protein, 363 aa, Agaricus bisporus
  source: /note="var. bisporus"
  source: /note="strain H97 / ATCC MYA-4626 / FGSC 10389"
MASGADVKVEFDPKDMPFRRLGPSGLRVPVFALGGWLTLGGTVKGDPVKEIIKTAFDAGINMFDTAEAYAKGESEREMGRVIQELGIRRTDIIISTKLFWGVRSGHNASGLSRKHIIEGTKESLERMGLDYVDVIFAHRYDVTIPMEEVVRAFNWVIEKGWAYYWATSEWTARDIEEAWHVADKLGLVGPIAEQCQHHMFHRERPEKEYDPLYRQYKMSTTTFSSLAGGLLTGKYNDGIPTGSRYDTHSTFFAKTIEALQSPEGQEKIRKVKELTKLAEQELDTTPGALALAWVARNTNTGCVILGASSAEQLRENLKAVKVIPKLTPEIMQKIEDILQNKPSPPDMYGRLPIDPLGREPLYI

SEQ ID NO: 3198 - protein, 438 aa, Agaricus bisporus
  source: /note="var. bisporus"
  source: /note="strain H97 / ATCC MYA-4626 / FGSC 10389"
MCEGDHEPQQSWNDAVLWHRDDKATPAPQDPHPERLYKPEVLKTIDDTINGLSEELRALSLDIHGHPELLFKEYYAHDTYTAFMRKHGWKVTEHLHLETAWEATFEHGQGGRVIGVNSEMDALPDIGHACGHNLIGIAGVAVSLGLRAALEKHNIPGKIVLLGTPAEEGGDGKAILLKEGAYKGMDACLMCHPAPGPLGSVSLTSCYAREKLIVEYEGHPAHSALSPWEGRNALDAAVLGYVNISALRQQLKPTTRVHGIFEAVDWAVNIVPAKARFICFIRAPTRSELLPTVERVLPCFHGAAQASGCEVKITHLSQSFDIRQNKALGDEVANIMLNKYGSIDYEWGIRYASTDFGNVSYDLPALHPSFSIPTVPNGGNHTHDFAKSAAMIEAHKQCLVMSIALAGAGLRVLTDDAFFTEVKKAFEEDKEIRKFKDA

SEQ ID NO: 3199 - protein, 436 aa, Agaricus bisporus
  source: /note="var. bisporus"
  source: /note="strain H97 / ATCC MYA-4626 / FGSC 10389"
MNPFGELNSQTTAQYLRTLPAIRERCLALYDLATQDKLLYFDYHPEKEADVVDFCLDIIKRDYNSDPNNIQPHGRWRHLDAGLPRIQPLLTTWSHLQIDIKEQSRRLIDLFLISVLLDAGAGNTWKYIEPGTNKTFNRSEGLGVASAHMFQSGFFSGVEGEPSAGLEKITVERTKEAMQVTSSNPMTGLEGRTSLLSNLSKALTSNPEFFGTEGRPGNLIDFLETQALPTTSNKKTIPLAALWTALLDGLNPIWPSRISLANIPLGDVWPSPTLAQSVSTTSQNRGTQESDILIPFHKLTQWMTYSLVEVFEKVLGWDVQGLDDMTGLPEYRNGGLLVDLGVLVLKPDMLPVNSESGLPTASAEHPAIVEWRAMTVIELDRIADRVRERLGLGKEELSLAQVLEGATWKGGREIAKMKRPGTGGPPIEIESDGTVF

SEQ ID NO: 3200 - protein, 467 aa, Agaricus bisporus
  source: /note="var. bisporus"
  source: /note="strain H97 / ATCC MYA-4626 / FGSC 10389"
MVSRTLLSRALRSAVRPARSYATVRNLGPLTEVTTLSNGLTVATESHSHAQTATVGVWIDAGSRAETDKTNGTAHFLEHMAFKGTGRRTQHALELEVENLGAHLNAYTSREQTVYYAKSFRKDVPKAVDIISDILQNSKLENAAVERERDVILREQQEVDKQLEEVVFDHLHAVAFQGQPLGRTILGPKKNILSIKREDLASYIKTNYTADRMVLVGAGGVDHNELVKLAEKHFSSLPISPNPISLGRLSHSKPSFVGSEVRIRDDDIPTANIAIAVEGVGWSSPDYFPMMVMQSIVGNWDRSLGLSTLNSSRLSHIVSQHNLANSFMSFSTSYSDTGLWGIYLVSENLMNLDDLVHFTLKEWTRMSTGATDVEVERAKSQLKASLLLSLDGTTAVAEDIGRQLVTSGKRLTPQQIETAVDAVSVDDIKRVASKYLWDKDFALAAVGSVEGLLDYNRIRADMASMLY

SEQ ID NO: 3201 - protein, 489 aa, Agaricus bisporus
  source: /note="var. bisporus"
  source: /note="strain H97 / ATCC MYA-4626 / FGSC 10389"
MATGDIGLIGLAVMGQNLILNMNDKGFTVVAYNRTVSKVDHFLANEAKGTKIQGAHSIQELASKLKRPRKIVLLVKAGSAVDDFIAQLVPHLEQGDIIIDGGNSHYPDSIRRAKELEAKGLLFVGSGVSGGEEGARHGPSLMPGGSPAAWPAIKEIFQKTSAQVNGDPCCDWVGETGSGHYVKMVHNGIEYGDMQLIAEAYDILKRGMGLSEDEIADIFLRWNKGVLDSFLIEITANILKFKDDDGEPVLAKILDKAGQKGTGKWTAIAALDSGTAVTLIGEAVFARCLSAIKDERMRASKVIAGPQKEPFKGDKKQFIDDLEQALYASKIISYTQGFMLMRETAQEMGWNLNYAGIAKMWRGGCIIKSVFLGDITAAYQKNPKLESLLFDDFFKKAVSTAQPGWRRINAQATLWGIPTPAFSTALAFFDGYRSEILPANIIQAQRDYFGAHTFRVLPGKENERFKAGEDIHVNWTGRGGNVSASTYST

SEQ ID NO: 3202 - protein, 521 aa, Agaricus bisporus
  source: /note="var. bisporus"
  source: /note="strain H97 / ATCC MYA-4626 / FGSC 10389"
MATPAKDLAQFTREEVAKHSSDDDQWVIIDANVYNISRFKRFHPGGLSVLLDPDVAGQDATEAFYSLHRHEVLERPAYQRLKIGTIAGEQSVIRWRVPGAISKVPYGEPTWLTDGYFSPYFSDKHRAFQKKIRQFMDTVVLPDALEREADGKRPSQSVFDKMAEVELHAMRMGPGKHLQGRTLMGGMVKPEEFDYFHELIITQEISRAVLRGYGDGLLGGKVIGLPPVLNFGSEELKARIVPDILAGKKFICLAISEAFAGSDVMGLQTTAVKTEDGKHWIINGNKKWITNGTFADYFTVGCKTEDGFTVILVERGPGIETSQIKTSYSTTAGTAYITFDNVKVPVENTLGEEGGGIFVILSNFNHERWVMCCASARGQRMIIEECLKWTTQRKVFGKPLNSQAVIRSKLAKMISRAESVQNWLENITYQMCNMTYRQQANKLAGQIAFLKSYSTSCGQDTARDAVQIFGGRGITQSGMGQFVEHYHRTIAFDALLGGAEDVLADLGVRQALRAMPEDVRL

SEQ ID NO: 3203 - protein, 534 aa, Agaricus bisporus
  source: /note="var. bisporus"
  source: /note="strain H97 / ATCC MYA-4626 / FGSC 10389"
MAYQAQEHVRRTFEQLLALLPEQERIRPQILLVAGEVTPYRNDTDREMLFRQESNFFYLTGCNLPSSALLASYQATPASSSTKPITTLFIPAIEEADIMWSIPPPDLVQARGLFDATNIEHPTSFPQAINALLKDAPNALVHTLPKNSPLFPQLPSQYLNQFSPNASPIDKYLLAALQRARLIKDAGELALIKKANEISSRAHETVMRVLGLAVKNKISREKDAGVTRPLLPGEWLIEKEAEAEAIFVASCRREGSIHQAYLPIVASAARAATLHYTCNDKDFAWGPVQPTDHLNNNSFTQTSHPNAAGQEIDPQVLLIDAGCEVNNYASDITRTMPVGNNGRFTPISGQVYDLVLEMQKAAFNMIKPGVHWDRVHLECHKVLVNKFIELGLFKNGTKEEILNSGVSAAFFPHGLGHSLGMDVHDAAEASRPANNETIPKENIGHEKLYPALRLRLPLEAGMVVTVEPGVYFHQHLIAPTRNSKYVDVEVLKKYEHMGGVRLEDVIVITQDGYENFTTVKSERNWVEGVCSGEL

SEQ ID NO: 3204 - protein, 533 aa, Agaricus bisporus
  source: /note="var. bisporus"
  source: /note="strain H97 / ATCC MYA-4626 / FGSC 10389"
MSVRAKSKVCLIVHDGWGIAAKKGLDGNAIEAADTTNMDSIANDHSFRTLHASGTAVGLTDGLMGNSEVGHLNIGAGRIVWQDIVRIDVAIKKRQFHKNSVLLETFERAKKGNGRLHLLGLISDGGVHSHINHLFALLETAKEVGVPHTYVHFFGDGRDTAPRSAAGYLKDLLEFMKKEDYGRLATIAGRYYAMDRDKRWERIKIAVEGLVNGVGEDSKGQDGAINTVEENYKKDVTDEFLKPIIVNGDEGRIKDGDTMFFFNYRSDRMREIATVFGQLEDVVDTKIPKDLEIATMSAYKVGFPFKVAFPPQKMDNVLAEWLSKQGLKQSHIAETEKYAHVTFFFNGGVEKQFEGEERHMIPSPKVATYDKEPKMSVLQVAEKVADVLRKGDHDFVMCNFAPPDMVGHTGVYDAAVEAVSATDKAVGEVYKAAEAAGYILLITADHGNAEQMKDLENGSPFTAHTTNVVPFIMSGDPKQLKFKEDDKNDEEEGALCDVAPTILDLMGVPQPEEMTGRSLLASGGKDAKKEDKK

SEQ ID NO: 3205 - protein, 617 aa, Agaricus bisporus
  source: /note="var. bisporus"
  source: /note="strain H97 / ATCC MYA-4626 / FGSC 10389"
MAGALQNAKRDLNKIRDEDRESRFGQVFGVSGPVVVAENMIGAAMYELVRVGHDELVGEVIRIENDQATIQVYEETSGVTVGDPVLRTGKPLSVELGPGLMGNIVDGIQRPLRSIQELSKSIYIPRGINTDALSRTIKWDFKPASFKVGDHISGGDIFGGIYENSLVDNHKVILQPKALGTITHIAEAGSYTVDDVILETEFEGKTTKHSMMQLWPVRAPRPVTEKLTADYPLLTGQRILDALFPCVQGGTTAIPGAFGCGKTVISQAISKFSNSDIIVYVGCGERGNEMAEVLMEFPQLTMEVGDRQEPIMKRTTLVANTSNMPVAAREASIYTGITLSEYFRDQGSNVAMMADSTSRWAEALREISGRLAEMPADSGYPAYLSTKLASFYERTGKVVCLGNPLRQGTVSIVGAVSPPGGDFSDPVTAATLGIVQVFWGLDKKLAQRKHFPSVNWSFSYSKYTKVLEPYYEREEPGFVELRTKTKEILQKEEDLAEIVQLVGKSALGENDKITLEVARMLKDDFLQQNGMSEYDRYCPFYKTSAMLKNFVAYHDAALKAVAQHDLTFAKIKDTTADIMFKLSQMKFESPSQGKEPIKQTLDSLYNEIQDKFRQIVE

SEQ ID NO: 3206 - protein, 635 aa, Agaricus bisporus
  source: /note="var. bisporus"
  source: /note="strain H97 / ATCC MYA-4626 / FGSC 10389"
MDPTTQSNYDKVATEHVEFDWRLDFENRIIQGSAVHQLTIKAENVHEAIFDTNDLTIDGVSIEGKATSFDLKPKHEVMGSALHVSLPSGLSKGAKLRVQIQYQTSPNSMALQWLEKEQTQGKQFPYLFSQCQPIYSRALAPLQDSPSAKITYSAKVKSVLPVLLSAIRVSPPADGPPHGGKIIGKDEIIYSYNQPVPIATYLIAIAAGNIHFRSFPQHEGKTWTSGIWTEPELLDAAYWEFSEDTTKFLAKEESLVIPYGFGVYDLLVLPPSFPYGGMENACLTFLTPTLVTGDRTLVDVVVHELTHSWFGNGVTHAEASHFWLNEGWTTYMERVLQQFLHSPAHRGFSYLIGNRALRDALEEYKDRPKYQRLIIGFEKGEDPDDAYSSIPYEKGANFLFYIEQTLGGLDVFLPYVKDYVSTFIGKSIRTEDWKSHLYGYFKDQPDKIKALNNIDWDAWFYGEGTELPVQLKFDTTLATQAYALAKRWDEARSTTDIPRLDFKETDLQKFDANQIVVFLEKLQSYSPLPSDLILHLGRLYGVSSTSNAEIRLRFYGVALQDASSPAAQHFAVEAAKWVIGDDGTGIIKGRMKFCRPTFRSISKVNHDVAVETFMKAKNYFHPIARKLIEKDLKLA

SEQ ID NO: 3207 - protein, 726 aa, Agaricus bisporus
  source: /note="var. bisporus"
  source: /note="strain H97 / ATCC MYA-4626 / FGSC 10389"
MSSLDALQPQDLAGLARPSAAVPNVAGDFAFTTISKYDFEEKKFNKTLVVFPVASTFTSAEIPLPKGEVFWLSGTTLAHVVEGDKDNLEIYAFEVCGGYDAATASDRPLDLSCNRVLIGTIPTKTATNFKYNARSRHLVFSDNVYDDYDLNTVNERDKLLASRGTTAMIYDSTYVRHWDTWVGPKKSALFCVALFLHPDYNWRMGPEFFSPMKGSSHHTPVEPFGGTDDFDVSPTHIVYTAKDPILPEAWHTKQNVYIVDIRGASKPRELTSGKQGATHNPVFNHQGDKVAWVELDEDGYESDRAKIVIYDLKVNVRYTLTQHWDRSVESLMFNMEGTFIYLTAGDQAKVKLFYLPVPPTPSESTTDPILDEIYTKPTELTSTGAVTGMYTMFTGRVLFSRSSLTSPNDAYLIQHLPRHLSDLTQPSERVAKGLKGDISKISGFTEAALREKWLHPGEEFYFAGANDKKIHGWAFKPRGWKEGDKKKWPVVLFIHGGPQGAWEDQWSTRWNPNAFTGQGYFVIALNPTGSTTFGRELTDAIKEDWGGKPFVDLINGWKYALDKYPEIDADRAVAAGASWGGYAINWIQSNPEFGFGFKALVCHDGVFDTQYNGFSTDEIFFFNHEWGGRPWEEKGKKLSTKFSPSNFVHKWSTPQLVIHSSKDYRLPETEGISAFQVLQQLGVPSRLLIFPDENHWVLKPENSVVWHEEIFRWFDQFVGEKKDESE

SEQ ID NO: 3208 - protein, 753 aa, Agaricus bisporus
  source: /note="var. bisporus"
  source: /note="strain H97 / ATCC MYA-4626 / FGSC 10389"
MPIRWTPGSYPKARRSDHVDTYQSATRGTVRVPDPYNWLEEHNTETDDWTSEQERYTRAFLDQIPDRDRLEQAFRASVDYAKFGAPTLHDDGRWYWSYNSGLQHQHGLFCPRCSVSSHSHCHLVVVYRSQDDTLPVFKDGSEPGEIFFDPNVLSDDGTVALTHFEFSKSGKLLAYGLSQSGSDESTLYIRPTDAPLNKRDDNQKLPDEIKHVKFSSVSWTPDSQGFFYQRFPAAQDQPSTNGINTGADENAMVYYHKIGTDQSDDILVHKDKDHPTWMFGITVTEDEKYLVLYTSRDTSRKNLIWIADLKKAKFGESILWQKLFDSFDAEYTYVTNDGPIFYFQTNEDASQRKLISVDVSADAVSPSIVIPERKDALLCDVTRVNKDHFVVQYKRNVKDEIYICDNNGRELERLYSDFVGTMSAHCRDTHSWLFVTMSGFNTPGTIAYYDFKRPEGQRLTPFRQTKVKGLNPDDFETRQVWYPSKDGTQIPMFIVRHKSTPFDGTAPCLQYGYGGFNISIDPFFSPMFLTFIQIYRGVIAVPNIRGGNEFGEDWHLGGSLKNKKNCFDDFIGATEYLVKNKYAGAGKVAINGGSNGGLLVAACVNRAPEGTFGAAVAEVGVLDLLKFHKFTIGKAWTSDYGNPDDPNDFDFIYPISPLHNIPDRVLPPFILLTADHFSPSNLSDDDRVVPLHSFKHAAQLQHMHSNNPYPLLLRVDKKSGHGAGKSVEKRIQEAADKWGFVAQSMELVWKHEK

SEQ ID NO: 3209 - protein, 783 aa, Agaricus bisporus
  source: /note="var. bisporus"
  source: /note="strain H97 / ATCC MYA-4626 / FGSC 10389"
MRCLLTASLVFATLAGSVYGHGRDSNSPLPRRKTLGFGPEHPHAVFNSNLHPLQTAGFVSEEPLDVARLFVTDLLGPSVSGGPSWKIRKDSYTDDNTGVTHVYIRQIVNGLEVADGDMNINIKDGRVLSYGNSFYNGPTPAPFSSTTAPEDLRHPQAEFCDQIPRHMPYAVPMPDGQVLLDAPSQSPVISHIAESNCAHPQLPASLTSDSSDFRPALLQFMLAATPNRELAQDITENYQKHIDDMLISDESHFAPGDEATVQFKVDNVPDAVNPAKARLAYIQLPSKLDGAMELQLVWKFEVEMQDNWYESAVTVSTPHRIISVVDWASDAPVPTPSPERKPATYKVFGWGVNDPECGERSVEKESFDGHASPAGWHAIPHEHDPSYISVRGQEKPGFWRNSTTTWGNNVLAQENWEGLNRFMDNYRPDGGEDRVFDYKYEPNETDKEDALAEAKAYINATVTQLFYTANLVHDIYYRYGFTEVAGNFQQYNFGRGGQQNDAVITNAQDGSGFNNANFMTPPDGQNGRMRMYLWNTAIPYRDGDLEAGIVIHEFSHGLSTRLTGGPANSGCLGWGESGGMGEGWGDFLATTIRSNRNYSDYSMGAWAANSITGIRHYKYSMDEDVNPSTYKTLDKPGYWGVHAIGEVWAEMLWVVSQGLIKKHGFSDTLFPPAPGPDGVVPRDHHFWRQDKDLLVPKHGNTLMVQLVLNGMKLQPCRPSFFDARDAIIEADRILTGGENVCLLWKGFAKRGLGFDAQVQGRTPWGGGIRTDGYAVHPDCRDEE

SEQ ID NO: 3210 - protein, 844 aa, Agaricus bisporus
  source: /note="var. bisporus"
  source: /note="strain H97 / ATCC MYA-4626 / FGSC 10389"
MGVKRPGVGSVGRSIDIQVNCYKAEAIDIPVYQYDVAIDPDSMPSRVNMEIFRQVQQDYANIFHKVLAYDGKKIAYATYQVPMGSTSRTFEVTLAPKNGGVTQKPGGRPPRVYKLKLSEAAIINTEVLRRYIAGSQSMNDAVSTSLAAFNTVLRMVPNLECVHNVRSFFNRKFGFEGIGGGIELWRGFFQSMRPGPGYLLLNVDIATCMMYRPGNLLEVCVDFFDNNVPARNLANYLANSDRERIRLGKFLSNLAVTVPATTKNKRRVIKGVAPRGADQITFDQDGKKTTVAKYFQQLGIRLQHPNLHCVEFRPGGALVPLELCQVQPGQIMRKQLPSDKTSKMVSFSTLKPPQRFQLIENGARDLQYGQSEYIRSFGLNINPTLMSLKGRILPTPKLQYGPGSKEPVVVPRFGAWNMAEKKLVRPMTVDRWLLVNLSRIFERDLQNIVRNLIQGFESTGITINHSPLIKPGDPQGNIPQILKSAGMEVFKQRGQPPQLIVIIMPDDGNAAVYSAIKHFGDIVMGVATQCLRPQKCRGANIQYWANVALKVNVKIGGINCTPERRAVPILSDPANATIIMGADVQHPAPGAEGRPSFTAVVGSVDQMASKYVAANALQVGRQELIDDLKTMVKDVLKLHMEYRTHQEKAKNPAPRKLIFFRDGVSEGQFEQVLRHELPLIRDACKEMKISPQITLCVVIKRHHIRFNPITEADRSQNCPAGTVVDTGITSPVEFDFYLQSHGGLLGTSRPSHYAVLYDENKFNADTMQSLSFALCHVYARATRSVSIPAPVYYADIVCARGKHHFPPEFAGRLSDDVSEAGSVESFRSQFMPLHDGQKKMMYFS

SEQ ID NO: 3211 - protein, 860 aa, Agaricus bisporus
  source: /note="var. bisporus"
  source: /note="strain H97 / ATCC MYA-4626 / FGSC 10389"
MPPSDFANADIDKIVDALTTDEAILLSAGVGFWHTHAIERLQIPAVKVSDGPNGIRGNHFFMGTPAKCLPSSTAMGATFDRDLLEEVGLKLLAREAKLRSASVILAPTCNIQRNPLGGRSFESFSEDPFLSGMLCSAYINGIQKGGIGATIKHFVGNDKEDDRTGYDSIIAERPLREIYLLPFMLAQKYASPWAIMTAYNRVNGIHVCENPELLQKILRDEWKSDVMIMSDWFGTYSVDVGLNAGLDLEMPGLNKWRTLESVNRSIQSRKVTAKKVKERARKVLELVKKCAQGAPEILDGDGLERTLDSDEDNALMRKFAAESIVLLKNDKKVLPLDRKSLKKVAIVGGNAKAAVLSGGGSAALKPSYFVSPYDGIVKALKEVNPNIEVTYSEGARAVKTLPTLDFDLFTESGQRGWTGSWHAHENDDSLVALPTPIKTQYVDETRMFISSSSPAGITKKWTLRMKGYLKPRERDCKFEFGLTAAGRAKLFVDGKLVIDNWTRQRRGVEFFGCGSEEETGVVELKAGVKHEIYVDFCNVRGPADGDETETIMDSNPGIRLGGAEVEDPDELLNSAVSIAKDADAVIIVVGLNGDWETEGNDRTTLALPGRTDELVQKVVAANPRAVVVTQAGSAITMPWVDQVSSLLHTWYLGNATGDAIADVIFGNHNPSGKLSLTFPKRLEDVPAHGYFHSEKGKVTYAEGLYVGYKHYQHRNIEPLFAFGHGLSYTSFNISDLRLSQPIVSGDQFDLKATVKLTNTGNITGSQVVQLYIGLPKTSELTHPRWQLRGFEKMRDVKPGESREVELVMDRLSVSYWDKEWVVENGAYDVRVAFTSEEGVGEGQELLGRFNVEKGFGWRGL

SEQ ID NO: 3212 - protein, 900 aa, Agaricus bisporus
  source: /note="var. bisporus"
  source: /note="strain H97 / ATCC MYA-4626 / FGSC 10389"
MLPLQVSRFTSLGARRCVVVAGQRRAAVQAVRSTTQTRNVQSVAQTDRDTIMRLLYSIGTKREVERHLRIFSSSSHPSQPAKFAVIKIGGAVLDDLDELALSLSFLYRVGLYPVVLHGAGPQLNVILEREGVVPDYIDGIRVTDAKTLSIARRVFLEENLKLVAALEALGTRARPITSGVFTADYLDKSKYGLVGKITKVDKRPLEASIRAGALPILTSLAESLDGQIMNVNADIAAGELAKELEPTKIVFLNDKGGMFHGVTGEKLDVINLDEEYEELMKQPWVKYGTKLKLREFKEMLDHLPRSSSIAVISASSLQKELFTDSGAGTLIRRGYRLFKYSSIERVGADRFRQVVHDRDPEVLSGHQSVTEVLNNLKKTPYTLYGDDPMDVVAVVSHPEGEVPVMTKLLSSRAGILNNVVDNVFNAIKKDHRKLFWTAPADDENRAWHFERADGSFTRAGKSLFWYGVQDVKEVEKIVEEFDKKGRIERNYLPVGPAAPPHKNVAAAAASGTRAYSTIARRLVGTQGKRGYATMAPEPVVQHTTQPKKVALIGARGYTGQALTTLLNAHPYLELSHVSSRQLVGRKLEGYDKSEITYSNLSMEDVERMEKDGEVDAWVMALPNGVVKPYVDAIDRGKKEGEKEGRKGSVVIDIGADYRFEEGWTYGLPELYGRSQIRTAKRISNPGCYATNAQMLLAPLVNLLNPASIPTVFGLSGYSGAGTVATTDSDGKPISLPKITPEALGGAVKPYALTDHIHEREAGFHLTDLISASASGTTNTAGKKVKVAFVPSVASWFSGIISTASVPLNRRVTAKEVVELFEEKYAKEKLVRVKKEVPVLGDVEGRHGVVLGGFQVHSEGERVVVVGGLDNLLKGAATQCLQNLNLSLGYEEYTGIPVDIE

SEQ ID NO: 3213 - protein, 1076 aa, Agaricus bisporus
  source: /note="var. bisporus"
  source: /note="strain H97 / ATCC MYA-4626 / FGSC 10389"
MSAQFHPKEDLVVSASMDQTVRVWDISGLRKGSPHQGGPGGMAGTSGPGSNHFETFDNFSTVKYVLEGHDRGVNFAMFHPTLPLIISAGDDRVIKIWRMSETKAWEVDSCRGHFNNVSSALFHPKHELIVSCGEDKTIRVWDLAKRTAIQTFRRDHDRFWYLAAHPNLNLFAAGHDSGLIVFKLERERPAFTVHQDTLYYVRDKYIRSYDFSSGSDIGLLSVRKFGSPYLPPRTISFNPAERSVILTISSDNGLYELSALPQSAQGEVKDSSADGKKGSGNSAIFVARNRFAALNKTTQLIEVRDLSNSTVKTIKPPVQTNEIFYGGTACLILSSTSSVVLYDIQQQKTIAELNSPPVKYVVWSNDGSLVALMSKHTITIANKTFSQHTLIHETIRIKSGAWDDSGVFLYSTLNHVKYCLAQGDHGVICTLDNPVYLTRVKGKTVHCLDRSARPRTITFDPTEYRFKLALLRNNYEEMLYIIRTSNLLGQSIIAYLQKKGFPEIALHFVQDTNTRFELAIECGNLDVAMETAREIDRPDCWERLAQQALKQGNHKVVEKAYQQTKNFDKLSFLYLATGSTEKLSKMQKIADARGDPMSRFHNALYAGDVAGRIAVLREVGLHPLAYLTAKGNGLDELAAEILEAAGLTEADIDDVPTFGASTLRPPPVVTSTENYNWPILSQGENYFDRALANGSLEGGVEPAYVNGDANAAASSALDAWARDEEIQDEIDPEEGGWELDADADEFKEDEAAEEVVEEEQELGAGAAPGVDETELWVRNSPLAADHVAAGSFESAMQLLNRQFGISNFAPLKPLFLSIYRSSHVYLSPVASLPPLKLHVRRNIGESAPSKVLPVAARSIQSVRSELAEGYRSVSSNKLTEAQATFRSVLQALLLVVIASDDEAKQWRDTVTSAREYLLGVSIELERRRVVEQEPDNLRRNLELAAYFTHCQLQPPQLQIALRSAIGAFAKANNQAHAARFAKRLLELNPDPKIAAQARQRIAAGDRNPRNTVEISYDEFTSFDICAATYTPIYKGSPSVHCPYTDAAYLPECQGKLDPLMELTEIGAPAAGLPAAW

SEQ ID NO: 3214 - protein, 103 aa, Agaricus bisporus
  source: /note="var. bisporus"
  source: /note="strain H97 / ATCC MYA-4626 / FGSC 10389"
MSGRGKGGKGLGKGGAKRHRKILRDNIQGITKPAIRRLARRGGVKRISGLIYEETRGVLKIFLENVIRDSVTYTEHAKRKTVTALDVVYALKRSGRTLYGFGA

SEQ ID NO: 3215 - protein, 101 aa, Agaricus bisporus
  source: /note="var. bisporus"
  source: /note="strain H97 / ATCC MYA-4626 / FGSC 10389"
MAKAKAAAPSGGKAAKKKKWSKGKVKDKAVHAVTLDKPTYDRILKEVPTFKFISQSILIERLKINGSLARVAIRHLKKENLIKPIVHHSAQLIYTRVTSSD

SEQ ID NO: 3216 - protein, 106 aa, Agaricus bisporus; identical to SEQ ID NO: 588
  source: /note="var. bisporus"
  source: /note="strain H97 / ATCC MYA-4626 / FGSC 10389"

SEQ ID NO: 3217 - protein, 137 aa, Agaricus bisporus
  source: /note="var. bisporus"
  source: /note="strain H97 / ATCC MYA-4626 / FGSC 10389"
MARTKQTARKSTGGKAPRKQLAAKSAARKTAAAAGGVKKPHRFRPGTVALREIRRYQKSTELLIRKLPFQRLVREIAQDFKTDLRFQSSAVMALQEAAEAYLVSLFEDTNLAAIHAKRVTIQPKDLALARRLRGERS

SEQ ID NO: 3218 - protein, 144 aa, Agaricus bisporus
  source: /note="var. bisporus"
  source: /note="strain H97 / ATCC MYA-4626 / FGSC 10389"
MGRVRTKTTKRASRVLIEKYYPRLTLDFHTNKRIIDEVSLVPSKRLRNKIAGFTTHLMKRIQKGPVRGISFKLQEEERERKDNYVPEISALDTTASGLEIDPDTKALLDALNFDSIQVNVVQPVTAQPERPRRERRNVPGAGRA

SEQ ID NO: 3219 - protein, 147 aa, Agaricus bisporus
  source: /note="var. bisporus"
  source: /note="strain H97 / ATCC MYA-4626 / FGSC 10389"
MPTRFSKTRKHRGNVSAGYGRVGKHRKHPGGRGLAGGAHHHRTNFDKYHPGYFGKVGMRHFHLTRNQYWRPIINVDKLWSLVPEEEKKGLTENSEVVPVIDTLQHGYGKILGNGKLPKLPFIVKARFVSEIAERKIKEAGGVVKLIA

SEQ ID NO: 3220 - protein, 178 aa, Agaricus bisporus
  source: /note="var. bisporus"
  source: /note="strain H97 / ATCC MYA-4626 / FGSC 10389"
MPPPKSKGGKMLALINWRLKVTINDGRALTGQMLAFDRHMNLVLADCEEFRRVRPKKKAGEETAPEQEMKRTLGLVILRGETVVSISVEGPPPVVDEDKKANNLPGGPGRGMPAGRGMGMMPPMGAPPLARPPMPFAPPGMPGPPPGFRPPGFPQGMPFPPPPPGFGGPPPGFQPPPQ

SEQ ID NO: 3221 - protein, 182 aa, Agaricus bisporus
  source: /note="var. bisporus"
  source: /note="strain H97 / ATCC MYA-4626 / FGSC 10389"
MFVLCDLDRSTSFVVELIVHQVILKLPSPSRQNAPKKVKVQKEEAVSLGPQVAEGELVFGVAHIYASFNDTFVHITDLSGRETISRVTGGMKVKADRDESSPYAAMLAAQDVAVRCREVGVTALHIKLRATGGTATKTPGPGAQSALRALARAGMRIGRIEDVTPIPTDTTRRKGGRRGRRL

SEQ ID NO: 3222 - protein, 196 aa, Agaricus bisporus
  source: /note="var. bisporus"
  source: /note="strain H97 / ATCC MYA-4626 / FGSC 10389"
MSVNNKILRTANAPTSPPDEIEIAVAQALIDLENNVPELKNELRALQISAAREVDVRGGKKAIVVFVPVPQLNAFHKIQARLTRELEKKFSDRHVVFIAQRRMLRKPTRNSRVKQKRPRSRTLTNVHEKILEDLVHPTEIVGKRTRVGVDGSKLLKVFLDSKDQTSLEYKLDSFSSVYRRLTGKEVVFEFPVVSQE

SEQ ID NO: 3223 - protein, 202 aa, Agaricus bisporus
  source: /note="var. bisporus"
  source: /note="strain H97 / ATCC MYA-4626 / FGSC 10389"
MSNPPPDDVEAELKPTATPGYNPGGSKSPEELAALDQEDESLARWKASLGIVPGTSATPAGPKLHVLTLELASSTLPSGKTISMDINNPQEMAAIKKNPIVIKEGVEYNVRMNFRVSGSIIPGVRYIQLVKRGGIKVDKFEKMLGSYGPRDEQYTVDFEPDDSPSGIIARTGTYNVVSRVVDDDGEIHANWEWQFKIGKEWA

SEQ ID NO: 3224 - protein, 194 aa, Agaricus bisporus
  source: /note="var. bisporus"
  source: /note="strain H97 / ATCC MYA-4626 / FGSC 10389"
METSFALIGKGYVIVAADTTSARSIVKMKNDEDKIKTVSPHLLMTYSGEPGDTVQFAEYIERNLRLYQIRNIYPLRPAAASSWIRRSLAESLRSRHPYSVNLLLGGYDTSLSEPKLYWIDYLGTVTEVPFAAHGYGSYFVLSLMDRYHDPEAPLEEGLETLKKCIQEVSKRLIVSPERYKVKIVDKDGVRDIDL

SEQ ID NO: 3225 - protein, 194 aa, Agaricus bisporus
  source: /note="var. bisporus"
  source: /note="strain H97 / ATCC MYA-4626 / FGSC 10389"
MVNLRSQKRLAASVAGVGKRKIWLDPAEQAEIGNANSRTHVKKLIKDGRVIVKPTTVHSRARTQMLLAAKRKGRHTGPGKRKGTSEARMPTKVQWMRRQRVLRRLLRKYRDAGKIDKHLYHSLYQKSKGNVFKNKRVLMEFIHKAKAEKNRTKILSDQMEARRVKNKAVRERRAARIAEKRQALIAIEHEDARE

SEQ ID NO: 3226 - protein, 216 aa, Agaricus bisporus
  source: /note="var. bisporus"
  source: /note="strain H97 / ATCC MYA-4626 / FGSC 10389"
MGISRTSRHKRSASGAQRAHYRKKRKFELGRQPANTRLGPKRIHEVRVRGGNIKYRALRLDGGNFAWGSESVTRKTRILTVVYNASNNELVRTNTLVKSAIIQIDATPFRQWYEAHYAQPVSKKSAKAQAAQAATDGATEEPKKLSNHAQRNLTERKKDAKIDPLLETQFGAGRLYARISSRPGQSGRADGYVLEGKELEFYLRKIRTGKQKHAHA

SEQ ID NO: 3227 - protein, 221 aa, Agaricus bisporus
  source: /note="var. bisporus"
  source: /note="strain H97 / ATCC MYA-4626 / FGSC 10389"
MSRSYDRALTVFSPDGHLFQVEYALEAVRKGTCAVGVRGKDVVVLGVEKKSVLQLQDPRTVRKVVMLDDHICLAFAGLTADGRVLIDKARVECQSHRLTVEDPVTVEYITRHIAGIQQRYTQSGGVRPFGISTLIIGFDPHDNKPKLYQTEPSGIYSAWKANAIGRSSKTVREFLEKNHKDDMTREESIKLAVKSLLEVVQTGAKNIEISVMEGYSKVTGQ

SEQ ID NO: 3228 - protein, 246 aa, Agaricus bisporus
  source: /note="var. bisporus"
  source: /note="strain H97 / ATCC MYA-4626 / FGSC 10389"
MTSIGTGYDLSASTYSPDGRIFQVEYATKAVENSGTAIGLKVKDGVVLAVEKLIHSKLSVPEANRRIQTIDRHIGLATAGLLADGRHIANRARDEATSYRDTYDAPSPLKNLAERLGLYTQAYTLYSSVRPFGISTILGAFDKEGPSLYVIEPSGVYFGYNGAAVGKGRQLAKTELEKLKLSELTTKEAVYEAARIIYLVHEDAKEKEFELEISWIGQETDNVHLPVPRELQQDAEAKAKAALETF

SEQ ID NO: 3229 - protein, 258 aa, Agaricus bisporus
  source: /note="var. bisporus"
  source: /note="strain H97 / ATCC MYA-4626 / FGSC 10389"
MLDSGSAVALSPIETSKRLAAYTAVDHHVKPEHTTIGIGSGSTVPYVVERIVQQGVEANKNRVFIPTGFQSKLLIIEAGLNLGDVDEFPSIDVTIDGADEVDKDLNCIKGGGACHLREKVLAEAAKTFIVVADYRKNSEYLGTTWAPGVPIEVVPVAYVRVLRHLKEVLGSPNATLRMALKKAGPVVTDNGNFVIDAPFDREKMMNSSKVLTQIKLLTGVVEVGLFCGMAKAAYFGNQDGTVAIRRADGTMEQVVAMQ

SEQ ID NO: 3230 - protein, 272 aa, Agaricus bisporus
  source: /note="var. bisporus"
  source: /note="strain H97 / ATCC MYA-4626 / FGSC 10389"
MSVFNATRLIGKTVIVTGASSGIGAATAVLFAKAGSNVILVARRQEILKQVADQCLAAHKESGLTQGGKFATVQLDVSDKTQVAGFLDKVPQELRDIDILVNNAGFVLGLDRIGDIKDSDIEGMFATNVFGLISMTQLLVREFKKKQAGHVINLGSIAGREPYVGGSVYNATKSAVRAFTGALLRELVNTPIRVTEIDPGLVETEFSIVRFRGDTSAAKKVYEGLEPLTGYDIAEEIVWAASRPPHVNIADVLVYPVNQASAVSTYRKPANM

SEQ ID NO: 3231 - protein, 277 aa, Agaricus bisporus
  source: /note="var. bisporus"
  source: /note="strain H97 / ATCC MYA-4626 / FGSC 10389"
MFRNTYDSDNTVFSPQGRLHQVEYALEAVKQGSAAVGLKSKTHAVLLALKRSTGELASYQQKMFRIDDHAGIAIAGLTSDARVLSNFMRQQAMSSKMLFNRAIPVNRLVSAIADKAQVNTQEYGRRPYGVGFLVIGYDESGSHLYEFSPSGNSYEYFAMSIGARSQSAKTYLEKHYEEFADASLEDLIRHGLHALRETLQQDKELNVNNTSIGLIGPRSEHEKKGVQPEGAFRILENEAIEPFLKTMVAKEDPPAPAPAASSSGPAASGSGDVQMSG

SEQ ID NO: 3232 - protein, 288 aa, Agaricus bisporus; identical to SEQ ID NO: 605
  source: /note="var. bisporus"
  source: /note="strain H97 / ATCC MYA-4626 / FGSC 10389"

SEQ ID NO: 3233 - protein, 304 aa, Agaricus bisporus
  source: /note="var. bisporus"
  source: /note="strain H97 / ATCC MYA-4626 / FGSC 10389"
MILLEPHNTIIQTTLLDKIAKPSTLDVQFVDFDGVRFHLTSGDKKTMILLSMNIRCWDELARYGAVDILKREYGALVLDQPENEYNVSLMIDLEQVPQDPESRDAFVMSIAMLKRNALSATFERAFQEQKELETSGGKAELMEIHYRDEEAIYVQASPDRVTVIFSTIFREETDRIFGKVFLQEFVDARRQPSIQNAPQVLYTNRDPPLEIRHIAGLRSTEDTGYVTFVLFPRHFSKPDVAAATISHIQLFRDYLHYHIKCSKAYMHSRMRARVTEFQKVLNRAKAEVATGEKKTVSGRTMVHR

SEQ ID NO: 3234 - protein, 312 aa, Agaricus bisporus
  source: /note="var. bisporus"
  source: /note="strain H97 / ATCC MYA-4626 / FGSC 10389"
MSVVPTPVNLALLICDELPAEFNYGTTTEIYDRWLSGSYPQGVLPRLNMMPYDVRERQEYPTAEELETIDAVMLTGSRDDAFGEDAWITRLLEYTKFIHTKHPRIRMFGICFGLQIISRALGGTVERNAKWEYGLTAINVTHMGKEIFGVERLYELQQIHQDHVPLPSLSNHFSTGSIYLLGSSIRTPNQSFVQLYERCNECELRGKCHEIHQHIRVLTFQGHPEFTDSIVTGLVRKWVKSGRIAEHDARVYFGEGNTPAHLLGKSDPEPMWPYEYDGINVVGRTFWKVFGVKYDDVTETDKSDGSADAGAV

SEQ ID NO: 3235 - protein, 315 aa, Agaricus bisporus
  source: /note="var. bisporus"
  source: /note="strain H97 / ATCC MYA-4626 / FGSC 10389"
MATAEEIRAQSYVGFDSITQQIEHKLLKRGFQFNVIVVGQTGLGKSTLINTIFASHLIDSKGRLQSDEPVRQTTEIQAVSHVIVENGVKLRLNIVDTPGYGDQINNEGCWDPIIKYIKDQHSAYLRKELTAQRERYIQDTRIHCCLYFVNPTGHNLRPVDVIVMKKLSDVVNVVPVIAKSDSLTLEERDRFKAKIREEVLYHNIRLYPFDTDEDDEEEVHLNESIREIIPFAVVGSENNVVIDGKSVRGRRNRWGVVNVEDPTHCEFVNLRNFLTRTHLQDLIETTAQIHYEAFRSKQLLALKDGVQQRPPQQAQ

SEQ ID NO: 3236 - protein, 356 aa, Agaricus bisporus
  source: /note="var. bisporus"
  source: /note="strain H97 / ATCC MYA-4626 / FGSC 10389"
MFSLSLSAVFLAASLARAQVTGTFPPTPLYSKHFPHPTDLPEKVDTDQGLIRGTQFGYNICNSTTEGPTSLCQTSYVNGIEDFCLWSTPTEGKPISDTEGETVAYCSKKGYGTRVMPAGTIKGLQVIKTPSYISYVGFIDQTLLGLPADDFGGELDPHGADLRGNPMGGVVYSKNFTSDGLPTQVPDWNLFIGGGGFCMKICDPADPNAARYCENRLDRIGCAYNLPSNAQTGTFEVCEGDNMEFPGVYTSNGATLTYAQPAESLGPITTVPYTPVVPSSSNCVTYTSAQIYTDLVAPSGATSSGASGAAPTAAGQSTSTATGRGAGSTDSPNDASALAVSGISLLGVVFASLFFS

SEQ ID NO: 3237 - protein, 357 aa, Agaricus bisporus
  source: /note="var. bisporus"
  source: /note="strain H97 / ATCC MYA-4626 / FGSC 10389"
MSQQQSASAAANDIQERIAAARREAESLKEKIRAKKETSADTSLRAMAAEVDPLPRIVMRPRRALRGHLAKIYAMHWAADRRHLVSASQDGKLIVWDAYTTNKVHAIPLRSSWVMTCAYSPSGNYVACGGLDNICSIYSLNNKDGGTNARGARELSAHSGYLSCCRFINDRQIVTSSGDMTCMLWDIEAGVRVIEFSDHTGDVMSLSLAPSNNNVFISGACDATAKLWDIRTGRATQTFTGHESDINAVSFFPNGDAFATGSDDASCRLFDIRADRELNTFTHDNILCGITSVAFSISGRILFGGYDDWTCNVWDTLKGERVGVLTGHENRVSCLGVSADGMALCTGSWDSTLRVWA

SEQ ID NO: 3238 - protein, 359 aa, Agaricus bisporus
  source: /note="var. bisporus"
  source: /note="strain H97 / ATCC MYA-4626 / FGSC 10389"
MAADAPPTVYKEAPILIEWDSLPEEDQFKQQEAMTKFLEEPGTIEKFLADCKKIGQKAAAIEVDFRTVLTGFSSFAANYGAYCPDVVTSYLPRWVAMMNRWTGGLLWSSRALAIETADSLTEYGRVLALIADIKTQSELEGAQNALRAYVDKHPISVVTQIVDGFKNLGIDLQNFSDDFAKYVGTFSVSSSATLTLEASIKSIIQCQATFADLNEKVQKSAMALGCSSVFGILPDIPVSSIGQYVVQRNEVQANLIKTKSGIINSTTDSIIEIIIRYYALLAMQAEFEQYKPNIVNICQDLSTFASVWAFATEQAIEINVALNEGMEVLTRKKFQLKLALLIVQIQPLREGLRTYAAQI

SEQ ID NO: 3239 - protein, 355 aa, Agaricus bisporus
  source: /note="var. bisporus"
  source: /note="strain H97 / ATCC MYA-4626 / FGSC 10389"
MSAYENAPSLTAWESLTEDEQIEHQEEMTKILEDPDTLKQFSEACKNIGQTAVAIDENFRTVQKGFNDLVEKYGADFPDVGRVYVPKWAGFMARWNGDTGMLWSSRKLAAETAASLTDYGINLALIADIQSQDDLEGAQMELKQYVEKHPVEIATRVSDQFKDLRNDIGDFSKDFTAYIEEQKQKLTEDAAAFEADILKYQAEIAELNEKIKIAGITLGFSFIFGVFSAIPAGFLIDFLVKRGKAQENLNQAQANLARTIAKQAALAAMQADFEKLKPNIDQICNDLGVFASVWAFATEQTTEINIALDEGMEVLTRKKFIVKLNLLIAQIEPLKEGMRQYATQITPPSSFADAE

SEQ ID NO: 3240 - protein, 370 aa, Agaricus bisporus
  source: /note="var. bisporus"
  source: /note="strain H97 / ATCC MYA-4626 / FGSC 10389"
MVSRLVLARLAPALRRPSASLLARRLPPSLRTYATADSEHSMTVREALNMAMEEEMMRDEKVFILGEEVARYNGAYKVTKGLMDKFGEKRVVDTPITEMGFAGLAVGAALQGLRPICEFMTFNFAMQGIDHIVNSAGKTYYMSGGNVPCPVVFRGPNGAASGVAAQHSQDYAAWYGSIPGLKVISPWSAEDCKGLLKSAIRDPNPVVFLENEMMYGVPFPMSQEAMRDDFLLPIGKAKVEREGGDVTIVAHSKMVTHSLEAADILAKEGVKAEVVNLRSIRPLDIDTIIKSVKKTNRLLIVEGGFPAFGVGSEICAQIVESEAFDYLDAPVERVTGADVPTPYATNLESMAFPDTPLIVKVAKRALYRTN

SEQ ID NO: 3241 - protein, 353 aa, Agaricus bisporus
  source: /note="var. bisporus"
  source: /note="strain H97 / ATCC MYA-4626 / FGSC 10389"
MTDSTSTKPMRQRMEEYVNNLQEHIVTTFEKLDPDAPPFKRDSWIRTQGGSGRSCVFACPTGDEAGTKSHQSILEKAGVNISVVHGVLPPAAIRQMRADHTSMPLPDRPEGLPFFAAGISLVIHPRNPHAPTCHANYRYFEITEPVNDNTTSPKILAWWFGGGADLTPSYLYESDAKHFHTSIKNACDKHGTELYSSFKKWCDEYFLIQHRNETRGIGGLFFDDLNSGPHQRLSSDSGIKRPVTPDEVFAFVKEVGDSFTSSYIPILEARHATPYTEHHRRWQLIRRGRYVEFNLIYDRGTKFGLMTPGARTESILMSLPETARWEYMSELGTEEGTEEAKLVQVLKEPRSWV

SEQ ID NO: 3242 - protein, 389 aa, Agaricus bisporus
  source: /note="var. bisporus"
  source: /note="strain H97 / ATCC MYA-4626 / FGSC 10389"
MTTRDEFKQAPHNVPGPIEVADEVLFANAHPSMSHVSPDFVPVFGDCIRMTREVLLTKSGQPFLISGSGTLGWDQVAANLVESGENALVLNSGYFGDSFKECLETYGANVAQLKAPIGRAVALSDLEKELRSGKNYKIVTVTHVDTSTGVLSNAKEIASLVRKISPETLVVVDAVCSVASEEIHFDNWDLDIVLTASQKGLGTPPGLSILVASERAMNVFKNRKSPPSSYYASWKKWLPIMKAYEAGSPAYFATPPVNLIYAYRASLNSIVLGDLSLEKRLKLHRAASRRVKDAAKKLGLRQLPESEGEAANGMTALYYPEGLAASDILPRLAKRNIVVAGGLHTEIKDKYFRIGHMGITAVNEERGDIETIVRALEEAVKEARAAKST

SEQ ID NO: 3243 - protein, 412 aa, Agaricus bisporus
  source: /note="var. bisporus"
  source: /note="strain H97 / ATCC MYA-4626 / FGSC 10389"
MSPLIINKAVPGAREFYPLNEPEIGTLWRPDCQDREVPKLFQPLTIRGITFKNRIWVSPMCQYSADNGHLTEWHLVHLGGFATRGVGAVTVEATAVVPEGRISPEDSGLWTDTQIDPLRRIVSFVHAQATKIGIQLAHAGRKASTHAPWIEEAAGRGTLSIATKEENGWPDEVYGPSTLSYKDGKYPNPKEMTESDINKVVDAFIASTKRAEQAGFDFIEVHGAHGYLIHSFLSPLSNTRNDAYGGQSLENRLRFICTLVQRLREIWSKPLFVRISATDWAEGPEKDSDGKWLQWGIEQSTILATRLQTLGVDLIDCSTGGNWASQKIPVAPGYQVPFAAQLKKALPDLLVGTVGLITEAEQAESFLKEGKADVILLARALLRDPHWPLHAARKLGVKIKPAGQYERAWAAL

SEQ ID NO: 3244 - protein, 419 aa, Agaricus bisporus; identical to SEQ ID NO: 842
  source: /note="var. bisporus"
  source: /note="strain H97 / ATCC MYA-4626 / FGSC 10389"

SEQ ID NO: 3245 - protein, 431 aa, Agaricus bisporus
  source: /note="var. bisporus"
  source: /note="strain H97 / ATCC MYA-4626 / FGSC 10389"
MSGQPQKTWTNDPWRPEDKWTPAPKDPHPERIYKPEVLKTIEGTIQGFSDELRALSLDIHAHPELSFKEYYAHDAYTKFMKEHGWNVKEHHHLETAWEATFEYGQGGRVIGINSEMDALDGIGHACGHNLIGIAGVAVSLGLRAALQKHDIPGKIVLLGTPAEESGNGKVDLLEEGAYEGMDVCLMCHPAPGPLGSISLSGSLAIQPILTEYEGHTAHASLSPWEGRNALDAAILAYNNISALRQQIKPTHRIHGIFEGQDWAPNIIPDKAKFTCLVRAPTRAEMKETATRVYPCFEAGGLATGCKVTITPVGEIWELRQNKALSDEVANIILNHHGSIDYGWGISGASTDFGNVSYALPSLHPGFAIPTVPNGGNHTREFAKAAATVEAHKQCLIISIALAGTAIRVLTDDTYFEEVTRIFHAHNWRILM

SEQ ID NO: 3246 - protein, 427 aa, Agaricus bisporus
  source: /note="var. bisporus"
  source: /note="strain H97 / ATCC MYA-4626 / FGSC 10389"
MASSGLDVTKARSHFPALRSGYIFADNAGGSQASQEVIDRISDYLSNTNVQLGADYSVSVESTRRVLVQGPTEVAKLFNARSPDEIVFGSSSTLNLENLARGLEQDIQSGDEFIVTGEHEANAGVWKKLAKRRGAVVKVWHAKPLNPENPYSVSLQIDDLLPLISSKTRVVAFTACSNILGSIVPVKQVNQAIRAAAKSKGAKKVQISVDCVAYAPHRQIDVQDWDVDFCVFSFYKVYGPHISGLYVRHSILQTSVNSIVHHFLKVDDVAYKLQPGGPGYETVYGTTGVVSYLLSLTPASNLQASWDAIALHEQTLVEPLIQYLTEPKQWARGVRIVGDAAVNLTRVPTICFVVVGDRAIKSKDIVEVFDKKGGIGIRYGHFYAYTLVSELTPKLNVDDGVVRISLVHYNTIEEVNRIIEILKEVLV

SEQ ID NO: 3247 - protein, 436 aa, Agaricus bisporus
  source: /note="var. bisporus"
  source: /note="strain H97 / ATCC MYA-4626 / FGSC 10389"
MARHSFTALNSNFVVDAQYRMVKELGQGAYGCVIAAVHSSTGEGCAIKKITNINTKRILTKRCLREIKLLRHFRGHKNITCLYDMDIVFRSDGNFDEVYLYEELMEADLHAIIRSGQPLTDAHFQSFIYQTLCGLKYIHSANVLHRDLKPGNLLVNADCELKICDFGLARGYSPGGGTSRAAGNQGFMTEYVATRWYRAPEIMLSFANYTTAIDVWSIGCILAELLGGKPIYKGRDYVDQLNQILHYLGTPPEETLRRVGSPRAQDYIRSLPIKPRVPFSTLYPRANPLAIDLLGQMLHFDPIKRIGCEQALNHPYFAVWHDPADEPVCPSTFDFSFEEEDTIEGMKKLIVEEVRSFRTEVRNQAKASSQIRRQDSLPIPSREEIINSPVQEHAPPHGATSGFTMSSMGQRPASPVYDDPSADLERELASTHLGKR

SEQ ID NO: 3248 - protein, 457 aa, Agaricus bisporus
  source: /note="var. bisporus"
  source: /note="strain H97 / ATCC MYA-4626 / FGSC 10389"
MPSLRLGDTAPDFEAETTTGNIKFHEWIGNSWAILFSHPGDFTPVCTTELGEVARRAPDFQKRDVKLIGISANGLEDHHAWVKDINEYGSKFGHTDVRFPIIADGDRKISTLYDMLDYQDATNRDAKGLPFTIRTVFVIDPKKTIRLMIAYPASTGRNFDEIIRVVDSLQLGDKHRITTPVNWNKGDDVIVHPSVTSEEAKVLFPEHTVHKPYLRTTPLKDAGKLVQIEHALAAVSQGTTSLGIKATNGIVIATEKKTSSILIDDSVVDKVAVICPNIGIVYSGMGPDFRVLVTRARKSAQAYWKIYNEYPPTRVLTQDIANVMQQATQSGGVRPFGVSLLVAGWDINRGPSLYQVDPSGSFWAWKASAIGKNMINAKTFLEKRYNDDISLEDAIHTALLTLKEGFEGQMTEKTIEIGVVTVPTPQELESSAVGPNTRPKPTFRKLTEEEVRDYLAL

SEQ ID NO: 3249 - protein, 477 aa, Agaricus bisporus
  source: /note="var. bisporus"
  source: /note="strain H97 / ATCC MYA-4626 / FGSC 10389"
MSGFRFLNLVRPFLPILPEVSSPDRKVPFNQKVLWTAVTLLIFLVCSQVPLYGIMSSDSSDPLYWMRVILASNRGTLMELGISPIVTSGMIMQLLAGANLIDVDFSLKEDRALFSGAQKLFALIISLGQATVYVLTGLYGQPKDIGAGVCLLLIIQLVAAALIVILLDELLQKGYGLGSGISLFIATNICESIVWKAFSPTTVNIGRGPEFEGAIVALFHLLFTWNDKGRALREAFWRERLPNVMNLIATIVIFVVVIYLQGFRIEIPVKSNRFRGQRGSYPVKLFYTSNMPIMLESALTSNVFIVSQMLATRFPANLLVRLLGVWEPMEDSPQLRAVSGVAYYMSPPHTMKEAILDPIHTAVYILFIISACALFSKTWIEVSGSGPRDVAKQLKDQQMVMAGHREGSMYKELKRVIPTAAAFGGAMLGLLSVAADLMGAIGSGTGILMAVTIIYSYWEIGMRESGGPEMAALGDLL

SEQ ID NO: 3250 - protein, 493 aa, Agaricus bisporus
  source: /note="var. bisporus"
  source: /note="strain H97 / ATCC MYA-4626 / FGSC 10389"
MSSSAYLLPFDLSAEQKPVQGTKDVVAQALWSSTPSGDKPPKVGTTRTFFNHPNGMTTTISSLGDKFKDKKGNERRELVRKAVGSGIKDLKAYDGVKEVAVDASADPHAAAVAAHLALYKFSLKTTPPDRFNPNNKEAIPEQLSIKPLEQSKEWETGRVYAEAQNWARTLMELPANMVTPTNFAERVKKQFEGIPNVEIFVRDEAWAEKKNMNTFLSVTHGTSEPAKLVEIHYKGAANKSDRPLALVGKGITFDSGGISLKPGANMKLMRADMGGAATVVSAAWALATLQVPVNMITVTPLTENMPGPSATKPGDIIYAMNGKSVEVDNTDAEGRLILADAVYYTATEHNPHTLIDVATLTGAMVVGLGEHFSGVFSTSTELWEKLQAAGEVEYDRFWRMPLDDDYLPQIHSSNADLQNTGGAPGGSITAALFIKAFAEGCEPKDDKPATLNWAHIDIAGTMDATRPGPYQEKGLTGRPVRGLVAYVRGLANN

SEQ ID NO: 3251 - protein, 494 aa, Agaricus bisporus
  source: /note="var. bisporus"
  source: /note="strain H97 / ATCC MYA-4626 / FGSC 10389"
MMSIDHLKKRYETAGQGHLLKFWDGLSPADQKSLSAQLEALDIERVNRIYKKAIVTEAASNDSAAQAEAIEPLPRDATDSIVGNSEKQQEWRQIGLDAVSRGCVGVLLMAGGQGTRLGSSAPKGCYDIGLPSHKSLFQYQAERIARLQRVAELENGKQAGSVIVPWYVMTSGPTRRDTEEFFIKNSYFGLNAADIIFFEQGTLPCLTMEGKVLLDTPSRIAVAPDGNGGIYAATRSPLSPGKPDSVLSDLEKRGILYLHAYCVDNCLVRVADPVFLGYGIQKQADCAAKVVPKASPTESVGVVARRGNKYGVVEYSEISKEQAERRDSETGELAFRAGNIANHFYTTSFLKRVESFEDELAFHIARKKIPHVDLESGQPVKPSKPNGMKLEMFVFDVFPFTERFAVLEVERREEFSPLKNAPGTGSDDPDTSRRDLLAQHHRFLERAGASIKPGVTIELSPLVTYDGEGLQAVKGKTFTKSGIIGSIEELDVLV

SEQ ID NO: 3252 - protein, 482 aa, Agaricus bisporus
  source: /note="var. bisporus"
  source: /note="strain H97 / ATCC MYA-4626 / FGSC 10389"
MSDNKKQEKDFTAEVDALLPEADKIAKSGKLQEALDKLFVLEKQTRNAADLASTTRLAKAIIQYTYDARNHALLNSSIQTLSKKHGQLKAAIQAFVEQAIEWLPEIKSRDGVEKWLELVETLRGVTEGKIFLETPRARVTLLLSHHHEGLAKEASNPQKSKESLQTASDLLSDLQVETYSSMERREKTEFILEQMRLLIAVARIKDDEQGKGKDGKDTLGGGEAEWVKVRVGGRKVNEQFLAEKENEDLKLKYYDLMMQHALHSSAYLDVAKYYYKVWETPSIKEDVNGKGKTALEHIVYYVVLAPHNNEQSDMLHHLYVDPALAKLELHYNLVKCFVTKELMRWPGIQSIYGSFLRKTPVFKVEKQWEDLHTRVIEHNIRVIAEYYSRIKLERLRSLLDLSLKQTEEILSRLVVSGTVWARIDRPAGIVNFRSKRSAEEVMNDWSSDMQKLLGLVEKTWMGMNAAQAAQARVKAATATSSS

SEQ ID NO: 3253 - protein, 533 aa, Agaricus bisporus
  source: /note="var. bisporus"
  source: /note="strain H97 / ATCC MYA-4626 / FGSC 10389"
MSLSRHINAEEIIEKSKDHPQIKFANAARRHGPANTSHWNRDEDVAGLSKYTIPPKGVSSRSAYQLLHDEMALDGNPTLNLASFVHTYMPEEAKKLMVENISKNIVDQEEYPAAQLIHNRCISMIADLWKAPKDAKPIGTATAGSSEAIMLGGLAMKKRWQEARKAAGKDYFHPNIVFGSNAQVALEKFARYFDVECRLVPVTEEHDFVMNPHDALQYIDENTIGVMVILGSTYTGHFENVQLMSDLLDNLQQRTGLDIPIHVDAASGGFFAPFAYPHLKWSFEIPRVVSINASGHKFGLVYVGIGWVLWRDESLLHKDLIFELHYLGSTEYSFTLNFSKPAAPIIGQMFNFLNLGVDGFKRIAVKDLRNARMLSRALNGTYFKVLSSIHLPVHEDRGDDVPEHYRSGLPVVSFRLSDEFKAANPQVEQKWIQTLLKTKGWIVPNYNAPEGTEDVEILRVVVRESVSEDLVERLIVDIVEITESLQGSEGNLMATTSNSAVHHPEKHHGRPDPENFGKSHKPAKKQAGFSRQC

SEQ ID NO: 3254 - protein, 582 aa, Agaricus bisporus
  source: /note="var. bisporus"
  source: /note="strain H97 / ATCC MYA-4626 / FGSC 10389"
MSSSKGPDPILLTLFANRFMSVAEAMGRSLQQTSISTNIKERLDFSCALFAPDGDLVANAPFIPIHLGAMSFAVKYQMKLHGSSLKEGDVLMANSPVAGGSHLPDITIITPVFAPNSKEIIFFTASRGHHADIGGILPGSMPPTSVNIFQEGAEIESFKIVDGGIFDEKGLIEYMVEKPSQYPGSSGCRNIRDVQSDLKAQIAANHKGIQLIHAIVEDYGLETVQEYMYHIRNNAETSVRNLLKDVAKRAGSNILSAVDYLDDGSPISLRVEINETEGSATLDFAGTGSEVRGNLNAPISVVHSAVIYCMRAMLDMDIPLNAGCLVPLDIKIPKKSLLSPSRTAAVCGGNVLTSQRIVDVVLKAFHACAASQGCTNNLTFGTGGKDKDGKAEAGWGYYETIAGGSGAGPGWHGTDGVHTHITNTRIGDVEILERRYPVLLHRFGIRTGSGGTGKWHGGDGVQREIEFLEPMQVSILSERRTRQPYGMEGGNSGMMGKNTWIKKLREGDGDLDNNNETGTRDINIGGKATVFMGKGDRLLIETPGAGAWGVAEEDGRKKDFVHVRAWEPRGSIADRAAAQAAF

SEQ ID NO: 3255 - protein, 600 aa, Agaricus bisporus
  source: /note="var. bisporus"
  source: /note="strain H97 / ATCC MYA-4626 / FGSC 10389"
MAAVADGPVLDLAEKHPEVVDDKVNARDEVSSEVDEVDDVHAGLEFPTEEERLTLRRVADALPWTAYLIAFVELAERFSFYGSQVVFTNFIQQPLPPGSHTGAAGLIGQAGALGLGQKAATGLNTFYQFWCYITPLYGAYIADTRWGRYKTICIAVGIALVGHIILIIAALPGVIEKKSAVGAFVVGMIVTGLGTGFFKSNISPLIAEQYKRTKIFVITTRHGERVIVDPSLTVSRMYMYFYLFINIGAVIGQISMTYAEKFVGFYLAFTLPTVVFLLCPFVLYFGRHRYNRTPPTGSVFSTALRLWKLAARGRWSLNPMQTLRNMRADDFWENVKPSNIKVEDRPKWMNFDDLWVDEVRRGFKACAVFLWIPLYWLTYNQINSNLLSQAATMNTHGLPNDILSNIDPIAIIIIIPICDLLVYPGLRRLGINFSALKKITGGFFTGALAMTWAAVLQHFIYKTNPCHYSAATCKDAEGNAIVSPLNVWLQTGAYFLIAVSEIFASITGLEYAFTKAPTNMRSLVMSAFLFTSAIASAIGEAFVSLSTDPLLVWNYGSMAVIAAIAGALFWLSVRRLDRDEDKLNNLGSGHMEPVRRDKEM

SEQ ID NO: 3256 - protein, 625 aa, Agaricus bisporus
  source: /note="var. bisporus"
  source: /note="strain H97 / ATCC MYA-4626 / FGSC 10389"
MLSRALSRAHRPFLATKAAVRTQSSWSSGKYPLIEHEYDAVVVGAGGAGLRAAFGLAEAGFKTACITKLFPTRSHTVAAQGGINAALGNMTEDDWRWHMYDTVKGSDWLGDQDAIHYMCREAPNTVIELEHYGVPFSRTKEGKIYQRAFGGQSLKFGKGGQAYRCAAAADRTGHALLHTLYGQSLRHDTNFFIEYFALDLIMQDGECVGVIALNMEDGTLHRFRSHKTVLATGGYGRAYFSCTSAHTCSGDGNAMVARAGLPLQDLEFVQFHPTGIYGAGCLITEGSRGEGGYLLNSEGERFMERYAPTAKDLASRDVVSRSMTLEIREGRGVGPEKDHIYLQLSHLPPDILHERLPGISETAAIFSGVDVTKEPIPVLPTVHYNMGGIPTRYTGEVITVDENGQDKIVPGLYAAGEAASVSVHGANRLGANSLLDIVVFGRAAAHHIRDTLTPGKPHKDIPQEAGLESIEFLDKIRQSDGPEPTAKIRLDMQKAMQTDAAVFRTQETLDEGVAKMRQIYNNFEKVGIKDRSMIWNSDLVETLELRNILQNAIQTITAAAARKESRGAHAREDFPERDDATWMKHTLSFQPDISTPDVVLKYRNVIDKTLDENECKPVPPFKRVY

SEQ ID NO: 3257 - protein, 612 aa, Agaricus bisporus
  source: /note="var. bisporus"
  source: /note="strain H97 / ATCC MYA-4626 / FGSC 10389"
MLRLISPSSRHLLRYSSPHHRKFPQQFRAMSAEQPTGSHQDPVTGEMISKQELKRRVASRAKEARKAEKVSAAPPDGAKQKVEAKSREDDLSPNQYYELRSRHVQHLKQTQNPNPYPHKFHVSMSITEYVEKFGPEGVVAPGSKLQGPVVSLAGRIHNIRASGAKLKFYDLHGEGTKVQIMASQQDDEQPEKYIETHEHFRRGDVVGVVGVPSRTKMGELSISPSSMTLLAPNLHQLPSSHFGLKDQETRYRKRYLDLILNDNTREIFIKRSKIINYIRRFLDNKGFMEVETPITSLLAGGATAKPFVTHHNDLDLDLYLRIAPELYLKELIVGGLDRVYELGRVFRNEGIDLTHNPEFTICEFYMAYADYEDLMDITEAMIEGLVKYLTGGSTKLIFHPDGNKGQEGARQLELEFKRPWKRYDMISTLEEKLGVKFPPGDQLHTDESNKWLRELLVKHNVDCSEPRTNARMLDKLVGEYIEPLCISPAFIVGHPQVMSPLAKWHRSRPGLCERFEGFLCGKEICNAYTELNDPFEQRLRFEEQTRQKNQGDDEAQGVDEVFIDALEHALPPTGGWGLGIDRLVMFLTDSTNIKEVLLFPAMKPIENPPAAS

SEQ ID NO: 3258 - protein, 662 aa, Agaricus bisporus
  source: /note="var. bisporus"
  source: /note="strain H97 / ATCC MYA-4626 / FGSC 10389"
MADTHIGVATHPVAPRVAQGTKTPHVGPDIHAYRAAHAQTVGDGSDEWWAKIARETLHWDRPFKTVRSGGFGTGDVVWFPEGGLNASYNCIDRWAYKNPNKTAIVYEADEPGEGCEVTFAELLREVSGIANVLKSFGVKKGDTVSIYLPMTWQGVAAFLACARIGAVHSVVFAGFSAEALRDRILDCKSRVLITSDEGRRGGKTIATKAIVDSALTKCPVVEHVLVLKRTGSNVPWTAGRDKWWHEEILKVPSYCPPEVMSSEDPLFILYTSGSTGKPKGVVHTTGGYLLCAALTNKYVFDVHEDDRFACMADIGWITGHSYIVYGPLANGVTTTVFESTPVYPSPSRYWQTVEKHRLTHFYSAPTAIRLLRRLGAHHVENHDLTSLRVLGTVGEPINPEAWHWYNDHVGKKQCAIVDTFWQTETGSIIVTPFPGAIETKPGSATVPFFGIEPAILDPTSGKELEGNSVEGILAIKNPWPSIARTIYQDHKRYLDTYMQPYPGYFYTGDGAARDEHGYIWIKGRVDDVINVSGHRLSTAEIESALIMHPGVAETAVIGTADDLTGQAVYSFVTLKPEFKYNQDDESSLTKELVLQVRKIIGHFAAPKKIFIVPDLPKTRSGKIMRRIMRKIIAGEGDQLGDLSTLAEPAVVDVIKQKVAAST

SEQ ID NO: 3259 - protein, 675 aa, Agaricus bisporus
  source: /note="var. bisporus"
  source: /note="strain H97 / ATCC MYA-4626 / FGSC 10389"
MSPSVRHPTRTQSRTLLSSLSILFLAALAVLCFFPVAAHAEETHPEYGSVIGIDLGTTYSCVGVQRGGRVEIIANDQGHRITPSWVSFTDDERLVGDSAKNAYHSNPQNTVFDAKRLIGRKMNEPEVKRDMKHWPFKVTEKNGKPSISVEHKGEERQFSAEEISAMVLGKMKETAEAYLGHKVTHAVITVPAYFNDAQRQATKDAGTIAGLHVLRIINEPTAAAIAYGLNKGSGESQIIVYDLGGGTFDVSLLSIDDGVFEVLATAGDTHLGGEDFDNRVIDYFVKSYKKKTGTDVSKNLRALGKLKREVEKAKRTLSSQQSTRIEIESFEDGNDFSETLTRAKFDELNMDLFRKTMKPVEQVLKDANVKKDEIDEVVLVGGSTRIPKVQQLLKEFFNGKEPSKGINPDEAVAYGAAVQGGILSGAEGTDGVVLVDVNPLTLGIETTGGVFTKLIPRNTVIPTKKSQIFSTAADNQPTVLIQVFEGERSLTKDNNLLGKFELNGIPPAPRGVPQIEVTFEMDANGIMKVSAADKGTGKSEGITIKNEKGRLSQEEIDRMVADAEKFAAEDEANRKKIEALNSLSSFVYGLKNQVTDSEGLGGKLDSDDKQTILDAVKEATEWIEENGSTASVEDLEEKLAEVQGVVNPITTKLYEGAGADGPSGDDDFEFDHDEL

SEQ ID NO: 3260 - protein, 780 aa, Agaricus bisporus
  source: /note="var. bisporus"
  source: /note="strain H97 / ATCC MYA-4626 / FGSC 10389"
MGGKGKAPETSARLRKRQDNGTSSYSGSVTSESVQNDEHVAEIFQSPRSRSQVEQMLDTPSASMVVVAILTTIAFALRFYKISHPDQVVFDEVHFGKFASYYITRQYYFDVHPPFAKLLFGLAGWFVGFDGEFTFDNIGDNYTLNNVPYIGMRALPAVLGSLTIPIVYAIMKESGYSTIIAAFSASLILFDNAHITQSRLILLDATLIFFMALTIYAYVRFRKLRYREFTTEWWVWLVLTGVFMACTWGSKVNGILTVACIGIAVLIDLWDILDHKKGTTMDYFYQHFIARAIGLIVIPFVVYLTFFYIHFSILVQSGSGDLYMSPAFQETLAGNEMLLNSAEIRYHDIITMKHKDTKVFLHSHAENYPLTYEDGRISSQGQQVTGYAHDDTNNFWQIIPTKAIPETGPGRVVHNGDVVQLLHVNTQTYLLTHDVASSLMPTNQEFTTWPKDDYKRYNDTLFAVNLIDSDSASWKTKSGYFRLVHVPTKVSMWTHTTPLPEWAFKQQEINGNKNSVEKTAIWFVNEIVDTDDPEGLDNRLEERPSKKPKSMNFLRKFAELQLLMLQHNAGLTGSHPYASTPINWPFSLTGISFWTENDSQKQIYLVGNLLGWWACVVGLSIYIGILGADLIARRRGLDPIADPVRNRLWNNTGFFMLVWAVHYLPFFLFSRQLFIHHYLPSHLASAMIAGSVLSFILSDTINFPISLRGPKTRPQTTQYADVGTKGVVTTVIFSLVMFVMFSYMAPLTYGSPGLTGEEVNSRRLLSTWTLHFAAKKTYDA

SEQ ID NO: 3261 - protein, 814 aa, Agaricus bisporus
  source: /note="var. bisporus"
  source: /note="strain H97 / ATCC MYA-4626 / FGSC 10389"
MADPSGAPPQPGPDDVSTAILRPKKSPNRLIVDEATNDDNSVGTLNPATMELLGLFRGDTIIVRGKKRRDTVLICLSSDDVEEGRIQMNKVARNNLRVKLADLVNVHQCLDIKYGKRVHILPFDDSIEGLSGNIFDVYLKPYFLEAYRPVRKGDTFLVRGGMRTVEFKVIETDPSEFCIVAQDTVIHTEGDPVKREDEESNLADVGYDDIGGCRKQMAQIRELVELPLRHPQLFKSIGIKPPRGILMYGPPGTGKTLMARAVANETGAFFFLINGPEIMSKMAGESESNLRKAFEEAEKNSPAIIFIDELDSIAPKREKTNGEVERRVVSQLLTLMDGLKARSNVVVMAATNRPNSIDPALRRFGRFDREVDIGIPDPTGRLEILRIHTKNMKLADDVDLERIAADTHGYVGSDIASLCSEAAMQQIREKMDLIDLDEDTIDAEVLDSLGVTMENFRFALGTSNPSALRETVVEVPTVTWDDIGGLEKVKLELQETVQYPVEHPDKFLKYGMSPSKGVLFYGPPGTGKTLLAKAIANECNANFISIKGPELLTMWFGESEANVRDVFDKARAAAPCVMFFDELDSIAKARGGSSGDGGGAGDRVLNQILTEMDGMNQKKNVFIIGATNRPDQIDSALLRPGRLDQLIYIPLPDEVSRISILTAALKKSPVAPEVDLNFLARKTHGFSGADLTEICQRAAKLAIRASIDADIRAEREKTARQEAGEEVMEEEVEDPVPMITREHFEEAMQYARRSVQDSDIRRYEMFAQNLQQSRGFGNNFKFPESGDSAAGGAPGAPAGNAGFQQEDADDDLYA

SEQ ID NO: 3262 - protein, 834 aa, Agaricus bisporus
  source: /note="var. bisporus"
  source: /note="strain H97 / ATCC MYA-4626 / FGSC 10389"
MKIAVATSGGDSAGMNAVVRAVVRSGILKGCEMWVVREGYEGLVRGNSQAVQNEGDLINAAAQSAAMDGAAIMKDADHVPDQNLTHNLRFGDGELLKDGTAESVGGRTLKGRYIVRVGWDDVRGWYSQGGTLIGTARSASFRAREGRLAAAHNLVKEGINALIVCGGDGSLTGADIFRSEWPSLIQELRDEGTISEEQLQSHTHLRLCGLVGSIDNDMSLTDLTIGAPTAVHRISEAIDNINSTAYSHSRAFIVEVMGRDCGWLAILAGVAGGADFIFIPERPPKVNPWEDDLCAEIKKHRALGKRKTIIIVAEGAQDLDLKPIRAEYIKDVLTERLGLDTRVTTLGHTQRGGPPCAMDRILPTLQGVEAVEAILESKPGTPTYMIGIQENKITRVPLMQAVEATRNVARLIKSKDFDNALAARGSDFLGYYEAFGSVSSLFDESSKLPLELRMRIGIIHTGAPAGGMNTATRAIARYCIRQGHIPLAIHNGFRGLLDGNVNELNWLSVDAWSPRGGSELGTNRCLPSMDIGAVAAQFQAYDFHGLVIIGGFEGFQSLLQLEQGRKHYPAFHIPMTHLPATISNNVPMTEYSLGSDTSLNTLVTACDAIKQSASASRDRVFVIETQGGRCGYIATMGALATGATLVYTPEDGISLDMLRQDVKFLRTRYAFDVKGKREGRIIIRNEASSDIYSTPVLTKMFEEEGGHLFDARSASLGHTLQGGVPSPMDRVHAVRLSIKCMQFLEVHHRESVAQGHKRNNADGDTAAVITIQSSSLKWVPVQEVYRHADMKNRRGKDTWWAGIKKLAENLGAKPQFLGLHTSSFESPRPSDLTL

SEQ ID NO: 3263 - protein, 1117 aa, Agaricus bisporus
  source: /note="var. bisporus"
  source: /note="strain H97 / ATCC MYA-4626 / FGSC 10389"
MLPVVIPLTMALSTFVLRILSPAFVLFTSLSLLSLRPSSPGSSSPITSVVVANIIPRRAAILSLLSIVSISYFLDGAAFVVYVVYEKVWPHHTGIEINSLLGVAAFAGLAALGAWKDVHGAPVWTLRRIKLVVALALLLDLALVVLLGLRIQQTRNENIPHIPETPPHVPVKDLLHFAFPAFRVLLLIPLLASLSSPRVVYASVETQDSDATLANDSTFLLPSDAGNTLSAGDPSVIAPKASKYGTFRDPRSNLQASAPATRPTTPAPSTVQTVQDKPESKAEISLEPDWSEIWRRLKRLTPYLWPSKSRYLQLLASFCVCILLVERVVNVAVPLILGLLVDILEGRSSLSPWIILLGFVCLRFLQGSGGLAAIRDSLWAPVMQYSDREMSQLSFDHILNLSFAWHTRRKTGEILRVLDRGAAINHTLELILFNIIPTFIDIFIALIVFCILFDWQIAAVIFLVMIAYVIEIFSVYASVTLTRYRTRVRRQMNDRDVITRGIHTDCLLNYETVKYFSGEEHEGERYREAIREYQALEYKVIIYLNLLNLVQNFIITLGLLGGSFMVAYRITQHPEDGSRKFVSFITYLTQLYGPLNQLGYIYRSVNQSLVDTERLLALLNEPSEVNDKENAPDLAVTSGEIEFDNVSFSYDYRTTALNGVSFKVPKGSSVALVGESGSGKSTILRLLYRFYDLREGEGRILIDGQDIRDVTQRSLRQAIGVVPQDPILFNSTIGYNIGYGKIGATPEEIEEATKSAQMHDRIMSFPDGYNTKTGERGVRLSGGEKQRVAIARTLLKNPPILLLDEATSALDTSTEKDIQKALQNLVQGRSSLSIAHRLSTIISADLILVLKEGQVVEQGTFKELLAYDGLFASMWADQVSATEDPAVSLAAGSVDRGVVLENSEDDERPVQEQISKDAFIIPSQGSHIVPSPKPLSVVDLPSSESALQKDDKAKTTEGVSFPSAEPYDVSEDRTTVAEAPPQPDVSSPPLAFPTSPEPERDDQGSSIRVAPAVTFGADVNSSRIGTPDLDSEPKRKRISSQNFQRLARRISVSAKRQGSSMIPSSMIPTIPGLMKRDSSPRVSVDDSNQRDVDSATGSIKGDDKGKKKKDKKDKTRK

SEQ ID NO: 3264 - protein, 1154 aa, Agaricus bisporus
  source: /note="var. bisporus"
  source: /note="strain H97 / ATCC MYA-4626 / FGSC 10389"
MSSTAIREYDAKLLLAYWLERAPPVAPHAQIKTNFQYPAARVAQISWDPATNTITPDTQIPSWVNNSKLVAKPDQLIKRRGKAGLLALNKSWPEAKQWITERAGKPQKVEAVTGTLNNFIIEPFLPHPSNTEYYVCITSQREGDRILFTHEGGVDIGDVDAKALILDIPVIAPFPTREDIASTLLKHVPAEKKDTLVDFLIRLYSVYVDLHFAYLEINPLVVLDAVNGGEPAIHYLDMAAKLDQTAESICGPKWAIARDLSVYEGGGSATTTKGSKVSADRGPPMVWPAPFGRDLTKEEAYIQKLDGSTGASLKLTVLNPEGRIWTMVAGGGASVVYSDAIAAHGFAHELANYGEYSGAPTEGQTYEYAKTIIDLLTRGNSRPDGKILIIGGGIANFTNVAATFKGIIRALKEYRNQLINHNVKIFVRRGGPNYQEGLKAMRLLGESLGVPIRVFGPDTHITEIVPLALGVDISQSRTASDDGLKSVQPGTPPPQVAAVGVTEDSVGTIHPDGGRTQPKDHIVHFEAGKASKRPWFRPFDAETRSFVYGLQPRAIQGMLDFDYSCGRATPSVAAMIYPFGGHHIQKFYWGTKETLLPVYTSLKDAVAKHPEVDVVVNFASSRSVYSSTLECLEFSQLKAIALIAEGVPERHAREILWKAKEKDVLIIGPATVGGIKPGCFRIGNSGGMMDNITSSKLYRPGSVGYVSKSGGMSNELNNILSLVTNGTYEGIAIGGDRYPGSTFIDHLLRYETDPDCKMLVLLGEVGGIEEYRVIEAVKTGKITKPIVAWAIGTCAKMFTTEVQFGHAGSMANSDMETADAKNRAMRDAGFIVPDTFEELPRVLRETYESLVRSRVIVPKKEVEPPVIPMDYKWAQELGLIRKPAAFISTISDERGQELLYAGMRISEVFKEEIGIGGVMSLLWFKRRLPSWATKFIEMVLMLTADHGPAVSGAMNTIVATRAGKDLISSLASGLLTIGSRFGGALDEAASMFSQAHDTGLTPREFVDSCRKANKLISGIGHKIKSVNNPDLRVELVKEYVIKNFPSHTLLDYALAVEKVTTSKKDTLILNVDGCIAVCFVDLLRDSGAFAPDEADEYIKIGALNGLFVLGRSIGFIGHHLDQKRLKAPLYRHPADDIFINMADVSQPRVLGRMQ

SEQ ID NO: 3265 - protein, 1107 aa, Agaricus bisporus
  source: /note="var. bisporus"
  source: /note="strain H97 / ATCC MYA-4626 / FGSC 10389"
MNDTMEVLDEKANGALMQDIEEIIPVTNHEAFVLKHMPDLGHDVKDFKVFTWHLANWKKLDKKLTGPEFDCGGHKWRILLFPFGNSNAPPNDTVSVYLDYAEPKKSPEGWHACAQFALVISNPNDPTIYTVSHAHHRFIAEECDWGFTRFSELRKLFSIQEPQSRPTIEDEAADITVFVRVLEDPTGVLWHNFVNYDSKKETGYVGLKNQGATCYMNSLLQSLFCTRYFRKAVYQIPTEEDIPTESVPLALQRVFYHLQSSDQPVGTTELTKSFGWKSLDSFLQHDVQEFNRVLQDKLEAKMKGTKAEGAIAKLFVGKMKSYIKCVNVEYESSRIEEFNDIQLNVKGMKDLHESFKDYVAVETLDGENKYHAEGYGLQDAKKGIIFESFPPVLHLQLKRFEYDIQRDAMVKINDRHEFPFEIDLSEFLDPAADRSQPWIYKLHGVLVHSGDLHGGHYFALIKPDAESRWLKFDDDRVTPVTDKEVLEENYGGEAINGLPPALQRNQVRAMKRFTNAYMLVYIRQSALIDVLPPFTEEDTPPHLKRRLDEERLQLEAKKREREEQHLFLTAKVITDETFARHEGFDLATFDEKNWPASDLPTFRVLKTETYSTFKNRVAQHFNFPENQIRLWVLVNRQNKTVRPDTHIPENEPALTVEVIRNNMAARQNDLRLYLDVIPDPSKPEPPAQSIMIFLKHFDTSKQTLYGLGKVYVLRNAKVGDLVPVINERMRWTPGTPLKLFEEIKPGMIEQMKPKFTFAQSEIQDGDVICFQIDLPEKEIHDYDAQGLYSNPLQFYDFLQNRVMIIFKPKYDEPDHDHPEFSLILSKKHNYDIMATKAGEYLRHDPIKLRFTTTHAGNGSPKSVLRRSLNQSISEIMGPNYINPSTTVILYEKLEVSIVELETKRSLKVIWTGVHNKEEATHPFLLPKTSPVHELADHLSKLVTLTPNGSHKIRIFEVSKDGKMQKEFTGSEMIGNIPDPVELFAEEVPKEEVEADESDKVIGVFHFSKDLTRTHGVPFKFVVKRGEKFIDTKKRLQERIGVTDKEFAKYRFALIQASTFKQPSYIEDGTDDTIYEHQFAPEDVLGLDHFDKSGRARTGGEKAIVIRG

SEQ ID NO: 3266 - protein, 1789 aa, Agaricus bisporus
  source: /note="var. bisporus"
  source: /note="strain H97 / ATCC MYA-4626 / FGSC 10389"
MSARPGRISQEGYSSASPSADTHLHDPFSSANGHGRRGYYDTESDIDYTRRDGYRETYASDGSSPALNEPGYYDNNPAYDMYPPQDTDSDGDVYQRYNVPPSSESLGPQGRVPFPDASTPTFLESSVPGASRDSYPAWTPENNIPLSKEEIEDIFLDLTQKFGFQRDSMRNMFDFLMQLLDSRASRMPANNALISLHADYIGGHHANYRKWYFAAQLDLDDAIGKTQNPGLNRLKSTRGKQQRPSEKTLLSALERWRQAMNNMSQYDRLRQIALYLLCWGEGAQVRFVPECLCFIFKCADDYYRSPECQSRVDPVPEGLYLRSVIKPLYRFIRDQGYEVMDGKFVKRERDHDEIIGYDDVNQLFWYPEGIARISLRNKTRLVDLAPALRFMKFHEIDWERAFYKTYYEKRSFGHLIVNFNRIWVIHISMFFYYTAYNTPRIYLPPGGSAAMTWSATALGGAVATVIMILATLAEFSYIPTTWNNTAHLTRRLIFLLITLALTCGPTVYIAIVEHNGGGGSVALILGIVQFFISVVATVLFAVFPSGRMFGDRVAGKSRKYLASQTFTASYPALDKSKRFGSILLWLLVFACKFAESYFYLTLSFSLPVAVMVGMKVQGCNDRIFGDALCTNQAAFTLTIMFIMDLVLFFLDTFLWYIIWNTVFSIARSFTLGLSIWTPWKDIYTRLPKRIYAKLLATQDMEVKYKPKVLVSQIWNAIIISMYREHLLSINHVQNLLYHQVDTGAGGRRSLRAPAFFVAQGDKGKKPEFFPPGSEAERRISFFAQSLTIAIPEPLPVHAMPTFTVLTPHYSEKTLLSLREIIREEDQNTRVTLLEYLKQLHPVEWENFVKDTKILAEESAMFNGNNPFANEKEGGSKVDDLPFYFIGFKSAAPEFTLRTRIWASLRAQTLYRTVSGMMNYSKAIKLLYRVENPEVVQMYGGNTDRLEQELERMARRKFKFLVSMQRYSKFNKEEHENAEFLLRAYPDLQIAYLEEEPPRKEGGDPRIFSCLVDGHSEFVPETGRRRPKFRIELPGNPILGDGKSDNQNHAIIFYRGEYLQLIDANQDNYLEECLKIRNVLGEFEEYAPPAQSPYLQWGLKDFKKPPVAIVGAREYIFSENIGILGDLAAGKEQTFGTLAARSMAWIGGKLHYGHPDFLHGLYMNTRGGVSKAQKGLHLNEDIYAGMNAFGRGGRIKHTEYYQCGKGRDLGFGTILNFQTKIGTGMGEQMLSREYYYLGTQLPIDRFLTFYYGHPGFHIHNMLVILSVHTFITTMVFLGTLNSNLRICQYTPSGQMIGGQGGCYNLVPVFEWIDRCIISIFLVFMISFLPLFLQELVERGTWKAVFRLAKQFGSLSPVFEVFSTQIYTHSILSNLTFGGARYIATGRGFATTRIYFSILFSRFAGPSIYLGFRTLIMLLYVTLTFWTNWLIYFWVSIVALCIAPFLFNPHQFVFTDFVIDYREFLRWMCRGNSRSHNNSWIGYCRLSRTMITGYKKKKLGHPSEKLSGDVPRARWRAVIWSEIIFPVCFAILFVVAYMFVKSFPDEDGNFGPSGLVRIAVISLGPIVFNAAVLLVLFIFSVFLGPMLDPVFPKFGSFMAFVAHALGTLGMIAFFEFLWYLERWDASRVVLGVIAVIAIQRAIHKILISVFLTREFKHDETNRAWWTGRWANRGLGSHLMSQPAREFIVKIIELSLWSSDLILGHMILFMLTPPILVPYFDRFHATILFWLRPSKQIRAPVYTNKQRRQRRWIVIKYGLFYVFVIALFIALIAIPALLHDRINIDCSFCQSL

SEQ ID NO: 3267 - protein, 89 aa, Agaricus bisporus
  source: /note="var. bisporus"
  source: /note="strain H97 / ATCC MYA-4626 / FGSC 10389"
MASSTVNVVRYTALFSGVLYGWYHRRTVQAENQKHQIEHAIHNRERLIAEARDAWKRKQDALKDTTVVTDPEDPRFDLDKLIAKWEESS

SEQ ID NO: 3268 - protein, 123 aa, Agaricus bisporus
  source: /note="var. bisporus"
  source: /note="strain H97 / ATCC MYA-4626 / FGSC 10389"
NGGRNKKGRGHVKFMRCSNCSRCVGKDKAIKRFTVRNMVESAAVRDINEASVYPEYVIPKLYIKIAYCVSCAIHSHVVRVRSREGRRNRAPPPRIRWKDGKKVNPAVAAAEDAKAAAAGGAKA

SEQ ID NO: 3269 - protein, 138 aa, Agaricus bisporus; identical to SEQ ID NO: 542
  source: /note="var. bisporus"
  source: /note="strain H97 / ATCC MYA-4626 / FGSC 10389"

SEQ ID NO: 3270 - protein, 120 aa, Agaricus bisporus
  source: /note="var. bisporus"
  source: /note="strain H97 / ATCC MYA-4626 / FGSC 10389"
MLAERMAKHKVDCWLINTGWTGGKFGSGKRCPLKYTRRIVDAVHSGELAKCEYENFGTFNLSIPTALEGVPRELLNPSLAWKDKEAFNKEVRKLGSMFQRAFALYEKDVEPKVREAGPQI

SEQ ID NO: 3271 - protein, 135 aa, Agaricus bisporus; identical to SEQ ID NO: 576
  source: /note="var. bisporus"
  source: /note="strain H97 / ATCC MYA-4626 / FGSC 10389"

SEQ ID NO: 3272 - protein, 147 aa, Agaricus bisporus
  source: /note="var. bisporus"
  source: /note="strain H97 / ATCC MYA-4626 / FGSC 10389"
MAPKPASTAGKAPASTASKAPAKSAEGAKAAKKTSKPVATGADGEKKKRKKVRRETYSSYIYKVLKQVHPDTGISNKAMAILNSFVNDIFERIATEASKLASYSKKSTISSREIQTSVRLILPGELAKHAISEGTKSVTKFSSAGSK

SEQ ID NO: 3273 - protein, 147 aa, Agaricus bisporus
  source: /note="var. bisporus"
  source: /note="strain H97 / ATCC MYA-4626 / FGSC 10389"
MALRRITRELNDLGRDPPSSCSAGPTGENMFQWQATIMGPGDSPYSGGVFFLSITFPTDYPFKPPKVSFTTKIYHPNINANGSICLDILRDQWSPALTISKVLLSICSMLTDPNPDDPLVPDIAHLYKTDRARYEATAREWTRKYAM

SEQ ID NO: 3274 - protein, 140 aa, Agaricus bisporus
  source: /note="var. bisporus"
  source: /note="strain H97 / ATCC MYA-4626 / FGSC 10389"
MASRLFLTADCLFCKIIKGDIPSLKLIETEFSYSFLDINPLSKGHALIIPKYHGEKLTEIPDEYLNDTLPIAKKIAVAQGVKEYNILQNNGALAHQVVGHVHFHVIPKPSAEEGLGIVWNHTTPPSEELKKVFEEIKSRL

SEQ ID NO: 3275 - protein, 145 aa, Agaricus bisporus
  source: /note="var. bisporus"
  source: /note="strain H97 / ATCC MYA-4626 / FGSC 10389"
MGSNKPRGLQAARKLRDSRRENRWADKLYKKRALGNVFKTSPTGGSSHAKGIVLEKVGVESKQPNSAIRKCVRVQLIKNGKKVTAFVPNDGCLNFVDENDEVLISGFGRSGKAKGDIPGVRFKVVKVSGVGLLALWKEKKEKPRS

SEQ ID NO: 3276 - protein, 149 aa, Agaricus bisporus
  source: /note="var. bisporus"
  source: /note="strain H97 / ATCC MYA-4626 / FGSC 10389"
MKLEIDSFSGYRIYPSKGRLFVRGDSKVFRFSSAKTQSLFLQRKNPRKIAWTQVYRRMHKKGITEEVAKKRSRRTVKHQRGIVGADLATIAARRNQTAAVRQQARLAAITKAKTEKKEKEAKKAKPTRQAAPSGPKVSKQQMKGGKGGR

SEQ ID NO: 3277 - protein, 159 aa, Agaricus bisporus
  source: /note="var. bisporus"
  source: /note="strain H97 / ATCC MYA-4626 / FGSC 10389"
MSSTAWTMSLEDRKRLIEAAFEAKNGTYSPYSKFPVGAALMAADGSIIKGANIENASYGATICAERTALVKAISEGVRSFVALAVTSNVKSAISPCGICRQFIREFCSLDMPILLVPGDYPQAGKSEPGYSEGGVRDTTLGELLPMSFGPEDLELPRRK

SEQ ID NO: 3278 - protein, 147 aa, Agaricus bisporus
  source: /note="var. bisporus"
  source: /note="strain H97 / ATCC MYA-4626 / FGSC 10389"
MLISKQNRRIIYENLFKEGVLVAKKDFNAPKHEDLDVPNLEVIKALQSLTSRGLVKMQFSWQWYYYVLTPEGVEYLREWLHLPAEIVPATYKKAARPTRPAGIRSGGEGAYRPPRGDRDDYRKKEGAPEGFSQKTQYAGVGRGGPRE

SEQ ID NO: 3279 - protein, 167 aa, Agaricus bisporus; identical to SEQ ID NO: 501
  source: /note="var. bisporus"
  source: /note="strain H97 / ATCC MYA-4626 / FGSC 10389"

SEQ ID NO: 3280 - protein, 168 aa, Agaricus bisporus
  source: /note="var. bisporus"
  source: /note="strain H97 / ATCC MYA-4626 / FGSC 10389"
MLLYEDILTGDEMFSDAFPFKEIDDVVFEVDCKMISVKAGVDVNIGANPSAEDQEEALEEGTSQVNNVVQSFRLQTTSFDKSSYKTYLKSYMKAVSAKLKESNPERASAFEKKAIEYVKKVLANFKDYEFYTGGGMDPDGMVALLNYREDGVTPYLTFWKDGLKIVKL

SEQ ID NO: 3281 - protein, 180 aa, Agaricus bisporus
  source: /note="var. bisporus"
  source: /note="strain H97 / ATCC MYA-4626 / FGSC 10389"
MPAYHSTFNELPDTRQVGNLAVLPFRTRIRGPAPIGDPSQYDIIDETLDLFRANSLFRNFEIKGPADRTLIILILYVSDCLAKLGSQRATPSQIEAGKLLNTLSVDNFAIPGDATFPLNAHYAAPASRANSEYLRGYLTQARQELAARLAEKLYADGTGKPSKWWMSFQKRRFMNRSLGS

SEQ ID NO: 3282 - protein, 202 aa, Agaricus bisporus
  source: /note="var. bisporus"
  source: /note="strain H97 / ATCC MYA-4626 / FGSC 10389"
MTIYYLLTFLLLAAEMVTFCVLVSPLPFYVRKRVLTLLTTSTFVSRIAYGLKISFIFVGILFADALQRMYRITVEAESAKSTSSGAIDARSESNLHARKFYSQRNVYLTGFCLFLSLVLIRTFQIMRDLIQTQEECGQLKKKANGKQPEDNKEVADLKKKLAERESEYGILKKQAGQNAKEYDRLATEYNKVSGQTSDKRRD

SEQ ID NO: 3283 - protein, 207 aa, Agaricus bisporus
  source: /note="var. bisporus"
  source: /note="strain H97 / ATCC MYA-4626 / FGSC 10389"
MSSNAIDFPFAHEDVVQKTVDDVRTLSNMSAAADQGVHDVNHSSKTLAERYKDDITALAVLPPRVDEFAKSFNDILWAGRTSATHGVSRITDFVDVTVVGIVEDIKTPEDRDEAVIELNAIAGQKSKPVDGFPGATRRLDGIWNTHRLMPPTSRRSLRKQLISRRQSSLLPCQSRLQKGSGSPQSIRVQHLNGCNYICGAIAVLISV

SEQ ID NO: 3284 - protein, 211 aa, Agaricus bisporus
  source: /note="var. bisporus"
  source: /note="strain H97 / ATCC MYA-4626 / FGSC 10389"
MAEGSNYDYLFKVVLIGDSGVGKSNLLSRFTRNEFNLESKSTIGVEFATRSINVDGKTVKAQIWDTAGQERYRAITSAYYRGAVGALLVYDIAKHATYVNVTRWLKELRDHADTNIVIMLVGNKSDLKHLRAVPTDEAKTFASENGLSFIETSALDASNVESAFQTILTDIYRIVSAKSLESSTSNIEPPKESISVGITQDTKQQQGKTCC

SEQ ID NO: 3285 - protein, 220 aa, Agaricus bisporus
  source: /note="var. bisporus"
  source: /note="strain H97 / ATCC MYA-4626 / FGSC 10389"
MATHALLQALRANKPAFGAWLTSPGLFHARTLAKSSPYLSWIAIDCEHGIIPLVPGAAESTVAIESAGVSPLIRIPATGATGSTSWQIKNALDAGARGVIVPMVSNADKAREIVGDCKFPPKGRRGFGSPFTHTTWGMNVPQYLESANENILVMVQIETKEAVENVREIAQVDGIDVLFIGPYDLSISLGYPPPSPDPHPDIEQVIQKILKEAHDAGKKW

SEQ ID NO: 3286 - protein, 221 aa, Agaricus bisporus
  source: /note="var. bisporus"
  source: /note="strain H97 / ATCC MYA-4626 / FGSC 10389"
MLSIARTALRSRTILTRGLAARAASVHTLPPLPYAYDALEPHICEEIMKLHHTKHHQTYVNGLNAAEEAYAKTDDIKAKINLQSALKFNGGGHINHSLFWKNLSPTSEHGGKLGDGPLKDEINNAFGSIDEFKKKFNAATAAIQGSGWGWLGWNSSTQQLEIVTTANQDPLLSHIPIIGIDIWEHAFYIQYKNVKPDYLNAIWNVVNFEEAEQRLLAAAKK

SEQ ID NO: 3287 - protein, 240 aa, Agaricus bisporus
  source: /note="var. bisporus"
  source: /note="strain H97 / ATCC MYA-4626 / FGSC 10389"
MDHIDFNRLKTGEVNLGTSIMAVQFQNGVVIGADSRTTTGSYIANRVTDKLTHVHDRIYCCRSGSAADTQAVADAVHYQLQMYTQMSGGPPPVHTAAALFQRICYENKDGLSAGIIVAGWDKEAGPSVYNIPLGGGLFRQPWAIGGSGSTYVYGYCDATYKEGWGRDETVDFVKNTLALAMSRDGSSGGVIRMCVITEEGVERLFVPGNELPKFWEGAEVLGHAKKINQAEGLAPMVVEA

SEQ ID NO: 3288 - protein, 220 aa, Agaricus bisporus
  source: /note="var. bisporus"
  source: /note="strain H97 / ATCC MYA-4626 / FGSC 10389"
MSFPTDPFEQLHYNMVRAHQTFKLGYDAILKNLENNQEAIKSDLPNFLGYCQAWVISIDTHHDSEEEIVFPFLNQKMDFEPEKEAHKVIHKGLSDITAIVTQFKADPSKFDPDHLKENLVKLKDPLFEHLDIEVEHIKSSKLKEVGFGDAELKDLNQRLDKYAQSHGDPFLVVPYMRSHTPPELKNVWPPMPWVLRKVVIPYVLAWKHSGYWKYAPYSVS

SEQ ID NO: 3289 - protein, 251 aa, Agaricus bisporus
  source: /note="var. bisporus"
  source: /note="strain H97 / ATCC MYA-4626 / FGSC 10389"
MPRQFFVGGNFKMNPIDRATEASLVGGLNKATLDPTTEVVIAPPAIYLISVKASVRPDVAVSAQNLYPKDSGAFTGEISPKQLVDAGIPWVILGHSERRTIFHESSEFVAQKVRAALDSGLKVILCIGETLQQRESGETGAVNEAQLKPVIAAIKNEEWKNIVIAYEPVWAIGTGKVATSTQAQDTQAEIRAVIRKSVSATVADEVRIIYGGSVTANNCKELATQPDVDGFLVGGACLKPEFANIVNARLA

SEQ ID NO: 3290 - protein, 249 aa, Agaricus bisporus
  source: /note="var. bisporus"
  source: /note="strain H97 / ATCC MYA-4626 / FGSC 10389"
MSYGGNYGSGGGFPPPAGRPTQGGGYGGPPGGGFGGSPGGGYGGPPGAGYGGASGYGGGFSAPQQSHGPPPGADPQLWNWFTAVDTDRSNHITAPELERALINGDWTPFDLDTVKLLMTIFDTDRSGTIGFNEFSGLWKYIKDWQNVFRHFDRDRSGSIDGGELQQALHQFGFNLAPPMIELVQKKYDVKASATQMPGAPVPGISFDRFVRACVVVKQLTEAFQKLDTDRDGWVQISYDQFMQTVLSLP

SEQ ID NO: 3291 - protein, 242 aa, Agaricus bisporus
  source: /note="var. bisporus"
  source: /note="strain H97 / ATCC MYA-4626 / FGSC 10389"
MFLTRSEYDRGVNTFSPEGRLFQVEYAIEAIKLGSTTVGIKTPDGVILGVEKRVQSPLLEASSIEKIMEIDNHLGCAMSGLTADARTMIDHARVTAQNHAFTYDERIKVESVTQAVCDLALRFGESVHDEEAMMSRPFGVALLIAGIDEHGPQLFHTDPSGTFVRYEAKAIGSGSEAAQSELQDKWHKQMTLKEAQVLTLRVLKQVMEEKLDQHNVQLAQVTKDKGFEILDEARLQAVIEEM

SEQ ID NO: 3292 - protein, 268 aa, Agaricus bisporus
  source: /note="var. bisporus"
  source: /note="strain H97 / ATCC MYA-4626 / FGSC 10389"
MSVYRSPGFDFSNSNRNNFLLNKGVPLPKATSTGTTIVGCVFKDGIVLGADTRATEGPIVADKNCEKIHFITEGIRCCGAGTAADTEFTTALISSNMELHALQSGRKPRVVTAMTMLKQTLFRYQGHIGAALVLGGVDPTGPQLFTIHPHGSTDKLPYVTMGSGSLAAMAVFESKWSANMERQEALDLVILAISAGIFNDLGSGSNVDACIITADGTEMLRNVDMPNQRVQKERDYKFRRGTTAWTKEDVRKFVVEETVTGTDEMDTS

SEQ ID NO: 3293 - protein, 265 aa, Agaricus bisporus
  source: /note="var. bisporus"
  source: /note="strain H97 / ATCC MYA-4626 / FGSC 10389"
MEQQQKAPADIRNVAQFLRSGGSGIKVRVGALDGKRLDYFKGKSAVKALLSPAYAKLKNVPKVATETEATTILSAVNAFAFYLRVQRGGPTGTSSSSPKALQIIREQVFRPDEYYAWFYEGSQWTTYAGGILMVAIMLAGVMFPLWPSIMRLGVWYLSIGMLGLIGLFFAIAIVRLIFYIVTVVTASPGIWIFPQLFADVGFVESFIPLWEWDVPKKKSKKKKGEKKEKGKSKNGSASPAIEVVESSDSQPFRGARVEEVPDEDA

SEQ ID NO: 3294 - protein, 252 aa, Agaricus bisporus; identical to SEQ ID NO: 481
  source: /note="var. bisporus"
  source: /note="strain H97 / ATCC MYA-4626 / FGSC 10389"

SEQ ID NO: 3295 - protein, 266 aa, Agaricus bisporus
  source: /note="var. bisporus"
  source: /note="strain H97 / ATCC MYA-4626 / FGSC 10389"
MDHFPTNWGNPRKETFDACSTYPLPHRATNDTQDAFSSGVQHTQQPIVTGTSVLALKYKDGVMMAADNLASYGSLARFKDIQRLHPVGKYTVIGAGGDMSDFQYIQKFLEQLIIEEFTSQDGHDLGPAQIHEYLSQVMYSRRSKINPLWNSLLVGGFKDGKSFLSYVDLLGTTYSATTLATGFGAYLAQPILRKEVEGRENELTEEEAIRVMESCMKVLYYRDARSLDKYQLAVITADGVKISESRHLSTTWSFAEGIRGYGAQTQ

SEQ ID NO: 3296 - protein, 273 aa, Agaricus bisporus
  source: /note="var. bisporus"
  source: /note="strain H97 / ATCC MYA-4626 / FGSC 10389"
MAFATQASRLIVPLGIAAAVVQASLYDVPGGYRAVMFDRFAGVKSQATGEGTHLLVPWLQRAILYDCRIKPRNISTTTGSKDLQMVSITLRVLSRPDVEHLSKIYQSLGMDYDERVLPSIGNEVLKSIVAQFDAAELITQREVVSSRIRADLLQRAGEFNIKLEDVSITHLTFGKEFTQAVEAKQIAQQDAERAKFIVEKAEQERQAAVIRAEGEAEAASTISRALDKAGDAFVALRKIEASKAIVQSLANNPNVTYIPSSGGGVLLNVPTNK

SEQ ID NO: 3297 - protein, 268 aa, Agaricus bisporus; identical to SEQ ID NO: 506
  source: /note="var. bisporus"
  source: /note="strain H97 / ATCC MYA-4626 / FGSC 10389"

SEQ ID NO: 3298 - protein, 289 aa, Agaricus bisporus
  source: /note="var. bisporus"
  source: /note="strain H97 / ATCC MYA-4626 / FGSC 10389"
MDGQEALRRIARQFRAAGGGGPGGPGKGLFAGSGLLIALVVGGYALNASLFNVDGGHRAIKYSRIHGVKPDIYSEGTHLVLPWVERPVIFDIRAKPRSIASLTGTKDLQMVNITCRVLSRPFQSNLPQIYRELGQDYDERVLPSIVNEVLKSVVAQFNASQLITQREHVSRLVRENLTQRALRFNMVLDDVSITHVAFSPEFTHAVEAKQAIQEKQSIIVRAQGEAQSAELVGEALRKNKGFLELRRLEAAREIATHLSTSGNKVMLDSQGLLLNIAGDDAKDLLKNTK

SEQ ID NO: 3299 - protein, 342 aa, Agaricus bisporus
  source: /note="var. bisporus"
  source: /note="strain H97 / ATCC MYA-4626 / FGSC 10389"
MNTEEISTNIITLTRHVLNDGLRLGDAATGDLTLLLTAISFTSKFIATNVRKARLINLVGLAGETNVQGEEQKKLDVLSNDIMVNALRASGKTAVLVSEELEDAIIIEDPYKGKYCVVFDPLDGSSNIDAGVNIGTIFGIYKIKDGSTGSVADVLRPGSEMVAAGYIMYGSSANLVLSTGQGVNGYTLDAALGEFILTHPNIQIPPRGKIYSFNEGNAMYFYSPVNAYLKSIKYPTAPKTPYSARYIGSMVADVHRTLLYGGIFGYPSDKKSKNGKLRLLYEAFPMAFLTEQAGGIATTGTSRILDIVPSGIHDRCPVFLGSRDDVLDLMKFYKEVPAEGTN

SEQ ID NO: 3300 - protein, 342 aa, Agaricus bisporus
  source: /note="var. bisporus"
  source: /note="strain H97 / ATCC MYA-4626 / FGSC 10389"
MSFPSTVEAITIPKVGGVEVIEKTTRPFPEVKPGDVVIKVEYGGVNFIDTYFRSGLYPLEKLPAILGKEVAGTIAALPTDPAVLNDETFKKNAFAVGGKVAVADFMGTHATYISVPWKLALPVPASISTRVAAAATLQGITAVSFFEEAYKVKKGDTILVHTIAGGLGLLFAQLGRRIGATVIGTTSTPQKAELAKSRGADHVIIYTKEDTVQRVLQLTNGQGVDAIFDGVGKTTFDSNFKMIKRKGTIVSVGNASGAVEPFSLLKLIEKNVKLLRPTMSKYVFTAEEAFYYGQQVWKLVDNGELKINIFKEYPFTAEGAREAQQDLTGGKTTGKLLIKIAD

SEQ ID NO: 3301 - protein, 340 aa, Agaricus bisporus
  source: /note="var. bisporus"
  source: /note="strain H97 / ATCC MYA-4626 / FGSC 10389"
MPVVIPPRKNERSKKLHSKVVIIGSGPAGHTAAIYLARANLSPLMFEGFMANGFAAGGQLTTTTDVENFPGFPTGILGPELMEKFREQSIRFGTRIITETVSKIDLSSRPFRYWREMQEGDEPETADTIIIATGASAKRLGLKGEQTYWQSGISACAVCDGAVPIFRNKPLAVIGGGDSAAEEATYLTKYGSHVYVLVRRAELRASKIMANRVLKNPKITVLWNTVAVECQGDGDLLNNLRIKNVQTGEERDLAVNGLFYAIGHEPATAIVRSQLQTDPDGYIITVPGTTETSVKGVFAAGDVQDKRYRQAITSAGSGCMAALEVEKLIAEEEELGEIDM

SEQ ID NO: 3302 - protein, 366 aa, Agaricus bisporus
  source: /note="var. bisporus"
  source: /note="strain H97 / ATCC MYA-4626 / FGSC 10389"
MSHSVHSMSSQKTEIPKVQKAAIVQKSGARVEVRSNVPVKQPEELAPGECLVKMHCTGVCHTDLHAAMGDWPIPTKAPLIGGHEGVGEIVAIGENTTHSPVKIGDRVGIKWIAYSCLECEPCRKSFEQNCENVQISGYTIDGTFQQYVVSYVHCVTPIPEGLDSAAAASLLCAGLTVYRALKYSETGPGDWIVLPGAGGGLGHLAIQYAKYMGRRVIAIDGGEEKRKLCLSLGADHWIDFKTCKDVTAEIKRVTGGKGAHATVVTTASSSGYSQAIDYLRPNGRLMAVGLPAKATLDADIFWTVYKSITIHGSYVGNRQDAIECVDIAATGAVKVHYAEKHIDDLEDVYSALNEGTIAGRIVLALN

SEQ ID NO: 3303 - protein, 372 aa, Agaricus bisporus
  source: /note="var. bisporus"
  source: /note="strain H97 / ATCC MYA-4626 / FGSC 10389"
MPFSALNSASKVPNVPGGPARSAEEFWAALLVSAGLVLAGGVFAGLTLGLMGLDELHLRVLATSSDDPKEKKNAQKVLKMMRKGRHWILVVLLLGNVIVNESLPIFLDSALGGGVAAIVISTAAIGSVIPQAVSVRYGLAIGATCSPLVLGMMYLFAPIAWPIAKLLDFILGANEQHTYKKAELKSFLQFHRTGEEPLRDDEIKILNGVLELNSKNVETIMTPLKDTVVLSADAVLDHKAVEAILLSGYSRIPVHEPGNPLAFIGLLLVKKLLNHDPSKRLPVSALSLSILPEAYPSINCFQALDYFQTGRAHLLLISLTPGKAGGAIGVITLEDIIEEILSEEIVDETDRYEDNQHKRRAKRATTAAIMRG

SEQ ID NO: 3304 - protein, 383 aa, Agaricus bisporus
  source: /note="var. bisporus"
  source: /note="strain H97 / ATCC MYA-4626 / FGSC 10389"
MVMTGNAGVYDPRRVLEHADFKVLQKGEKPVPGANIAAFYNPAHEIHLVQKPRPKPGPGQVLLHVRATGICGSDVHFWKHGRIGDSMVLSDECGSGHESAGEIVEVGEGVTQWQPGDRVAIEAGVPCSQPSCDACRLGRYNGCPDVVFFSTPPYHGTLTRWHLHPAQWLHRLPDNVSFEEGSLCEPLSVALAGIERAGLRLGDPLLICGAGPIGLVTLLSARAAGAEPIVITDLFQSRLDFAKKLIPGVRTVLIKKELTAKEQAEEVKKAAGCQLTVTLECTGVESSIHTAAYSLKFGGKLFIIGVGKSEQILPFMHLSVNEIDVGFLYRYANQYPKAIRLISSGLVNVKPLVTHRFALEDAIDAFHVAADPTQGAIKVQIRD

SEQ ID NO: 3305 - protein, 368 aa, Agaricus bisporus
  source: /note="var. bisporus"
  source: /note="strain H97 / ATCC MYA-4626 / FGSC 10389"
MSNPKPFVLRWGIISTGRIAGDFVEDILLDPKTRDVVDVIHKVVAVGSRTAGKAQEFIDAKAGGDKNIKAYENYADVYADSDVDAVYIATPHTFHYEEALAAIEARKHVLIEKPSTATSAELRHLLQIAEQKKVFVMEAMWTRFLPLTQEVLKVIDEEDLGRPITLHADLSGDFHIDKLSLEHRILNPRLGGGALLDLGPYVMVWAIICIFEHSSNHNSRPTSISGLMLKSPLTGVDTNTSFTLNFPDAQAILTASINVNSISSFGCNVRYERGTVNISSPLYCPKEFTVKHHDKTGRTIRHVTRFGDYVGGGWHFQADEVARCIRDGKKESEIWSHQKMILVMEVFDEVRRQGGYVFPPGVEKVVSV

SEQ ID NO: 3306 - protein, 407 aa, Agaricus bisporus
  source: /note="var. bisporus"
  source: /note="strain H97 / ATCC MYA-4626 / FGSC 10389"
MATQSSSPAYKRLLEQHDDDVVIVSAIRSAMTKGKKGGFKDTKPDYILSQVLRSVYSRVNLDPKLIEDISVGNVLPPGGGASAARMAALYAGIPNTTAINTVNRQCSSGLTAVSQIANEIKVGQINIGIGAGVESMTNGFGSRAAPEISDSVLENQEAEDCLIPMGLTSENVAKDYNIPRQVQDEFAAKSFQKAAAAQKAGKFKDEIVPIKTTIVDPKTEKEVEIVVDADDGIRDGVTAASLSKLKPAFTKDGCTHAGNASQVSDGAAAVLLARRSVAKKLGLPIVGKYVNSAVVGVPPRIMGVGPAFAIPKVLDLVGLSKDEVDFYEINEAFASQAVFSIQHVKIPFEKVNINGGAIAMGHPLGCTGARQISTGLSVAKQTGGRVFVTSMCIGSGMGMAAVFVSEH

SEQ ID NO: 3307 - protein, 394 aa, Agaricus bisporus
  source: /note="var. bisporus"
  source: /note="strain H97 / ATCC MYA-4626 / FGSC 10389"
MKAVVALGFLAPSVLAATVPNELFSSLVPQKILATFNDLPNPTQYPQYTDQQAGDWQYFNPNTWTSGFFPSTLYALNTRRTLCGATSRNGLGIANWLELGREASRALIPLETKNSQGHDVGFLSFPFVEELAVNPNSETAVTAINSFAKLLANRFNPTVGCTRSWDAPDPDFQVIIDNMMNLEVLFHSAELTNNDTLRTIGKKHADTTMINHIRQDGGTWHVLHYNTFTGAVTAKRTAQGFADSSTWSRGQAWGIYGYATMFKLTGKAEYRDTAVRLADYFLDHIPNDGIVPWDFNAPSPKPADSSAATIAANGLLLLSQLETTPSLKEKFSNAAIELLDKITDLAWNPSWQSLLSNGTVNAPARNQLTGTVYGDYYFVKAGNELISMGLASCT

SEQ ID NO: 3308 - protein, 406 aa, Agaricus bisporus
  source: /note="var. bisporus"
  source: /note="strain H97 / ATCC MYA-4626 / FGSC 10389"
MTVYQATASAPVNIACIKYWGKRDTKLILPTNSSLSVTLDQDHLRSTTTSRADPSFTNDRLWLNGKEEEIKEGGRLWTCIREMKRLRKEEVEDKSSSEPKLSTYNVHICSHNNFPTAAGLASSASGFAALVSSLSHLYSLPVSSSTLSLIARQGSGSACRSLFGGFVAWQMGSNPSGSDSLALQIAPQSHWPDIHALICIVSDDKKGTSSTSGMQRTVETSSLLHHRINTVVPHRMETISKAIQEKDFDTFAKVTMADSNQFHAVALDTEPPIFYLNDVSRAIIALVVEYNRLGVEEGKGYRAAYTYDAGPNAVIYAKKENVKEILELVVEYFPQREGAFKDAFGLFGGGGKVGGKLPMGFNENVAKRFEVGAVKGLIHTRVGDGPRKLGDGEGLLNDEGLPKSLA

SEQ ID NO: 3309 - protein, 380 aa, Agaricus bisporus
  source: /note="var. bisporus"
  source: /note="strain H97 / ATCC MYA-4626 / FGSC 10389"
MSLAPVNDGIGIANLPNQRHKIVAKRGAHFTLMVVGESGLGKTTLINTLFSTELSPPKNYNRRHHKQLDKLTEVEIIKAELEEKQFKVKLTVIDTPGFGDYVNNADSWTPIVEFIDDQHEAYMRQEQQPQRNEKTDLRVHACLYFIRATGHTLKPLDIEIMKRLGTRVNLIPVIAKADTLTQNDLQTFKQRIREVVDAQGIRIYSPPIEPDDESADLARVLIDSMPFSIIGSTEDVKTADGRTVKGREYLWGVAEVENENHCDFKKLRSLLIRTHMLDLVSTTEDIHYENYRQQQMETRKFGEPKPKKLDNPKFKEEEETLRKKFTEQVKAEEARFRKWEQHLIQERDRLNKDLEEAHSAIKQLEAELDNLNYGRGTNRR

SEQ ID NO: 3310 - protein, 407 aa, Agaricus bisporus
  source: /note="var. bisporus"
  source: /note="strain H97 / ATCC MYA-4626 / FGSC 10389"
MLARHIFRVQKLSRGFATHAESFTGLPATLHLKTGQSFKGKSFGAPHSRFGETVFSTSITSYTESMTDPSYRGQILVFTTPMIGNYGVPHNEAPYDSQDVGVVLESKGVQCAAVIVGDVAERFSHYNAVESISSWCKRHNVPGITGVDTRAITTLLRDQGTTLGRVAVGPDACLPAPAASEYWDPITENLVDQVSTKVPYELNPTGDIRVAVLDFGAKANILRSLVRRGAAVTVLPWNYDFNAIRDQYDGLFLTNGPGSPSHCMEAALNLRKTIQQWNKPIFGLCMGHQIIGMAAGLEAYRMTFGNRGHNQPVLALASSGSIKAGRVYVTSQNHQYALKLQDTFPAGWEPFFINCNDSSVEGIKSTAESGKNVIGVQFHPESSGGPLDTIEVGSVIAGKSYQILTPS

SEQ ID NO: 3311 - protein, 387 aa, Agaricus bisporus
  source: /note="var. bisporus"
  source: /note="strain H97 / ATCC MYA-4626 / FGSC 10389"
MRFSLRPSRSSNRNGRPMSPIRRRKLLLSYVPDWLLTIVLAGIFFSLDKVEGYRRVFALEDTSLRHPYAVHERVPNIALYFICFVAPFLLQPVVNVFTIRSWWDLHNSSLGLILSLALTGSVTQFSKITVGRPRPDIVDRCQPPIGATDPEFGLSSWEICTQPDNGILRDGFRSFPSGHSSMSFAGLGFLSFYLAGKLHLFDKRGHTGKAWLSLAPFCCAALVAISRTMDYRHHWHDVLVGSLLGTVMAYFSYRQYYPPLESELSHRPFSPRIKREDDELIPTHNHHPSGSNFPFVQAPTTSTQGNGQYTATNNDEYELDGTVLRPHTEPLEEIWKRDGPGVSDTDQSPSYEGGEQVYQANTAPSLPPIRTSSPPQAYVYEPRAQPV

SEQ ID NO: 3312 - protein, 402 aa, Agaricus bisporus
  source: /note="var. bisporus"
  source: /note="strain H97 / ATCC MYA-4626 / FGSC 10389"
MAAVAVKSPVAPAGIKQYYQAKIESAELLINQKTQNLRRLEAQRNALNARVRLLREELQLLQEPGSYVGEVVKVMGKNKVLVKVQPEGKYIVDIDSDVEVSALKATLRVALRSDSYTIHKILPNKVDPLVSLMMVEKVPDSTYEMVGGLDKQIKEIKEVIELPVKHPELFEALGIAQPKGVLLYGPPGTGKTLLARAVAHHTDCKFIRVSGSELVQKYIGEGSRMVRELFVMAREHAPSIIFMDEIDSIGSSRGESGSGGGDSEVQRTMLELLNQLDGFESTKNIKVIMATNRIDILDSALLRPGRIDRKIEFPPPGPEARVSILRIHSRKMSLQRGINLRALAEKMGQCSGAEVRGICTEAGMYALRERRQHVTQEDFEFAVAKVLKKNQEGNTSVNKLFS

SEQ ID NO: 3313 - protein, 396 aa, Agaricus bisporus
  source: /note="var. bisporus"
  source: /note="strain H97 / ATCC MYA-4626 / FGSC 10389"
MAGINAGDEKLVFESSEAVSVVATFDDLALKEDLLRGIYAYNFEKPSAIQQRAILPITQGRDVIAQAQSGTGKTATFSISILQSIDVTVRETQALVLSPTRELATQIQSVVLALGDYMNVQCHACIGGTSIGEDIRKLEYGQHVVSGTPGRVFDMIRRRSLRTRNIKMLVLDEADELLNKGFKDQIYDVYRYLPPATQVVLLSATLPYDVLEMTTKFMTDPIRILVKRDELTLEGIKQFFVAVEKEDWKFDTLCDLYDTLTITQAVIFCNTRRKVDWLTEKMRASNFTVSSMHGDMVQKERDAIMAEFRSGTSRVLITTDVWARGIDVQQVSLVINYDLPANRENYIHRIGRSGRFGRKGVAINFVTVDDVRILRDIEQFYSTQIDEMPVNAAELI

SEQ ID NO: 3314 - protein, 407 aa, Agaricus bisporus
  source: /note="var. bisporus"
  source: /note="strain H97 / ATCC MYA-4626 / FGSC 10389"
MASFAARSASQVLRASRRTSAAVARADLKPQAASYSLLARTASAKVILNPTFQTVRGVKTLDFAGTKETVYERADWPLAKLQDYFKNDTLALIGYGSQGHGQGLNARDNGLNVIVGVREGGESWKQAMEDGWVPGETLFPIKEAIHKGTIIMNLLSDAAQSQTWPELAPLITPGKTLYFSHGFSVVYKEDTKVVPPKDVDVILVAPKGSGRTVRTLFKEGRGINSSIAVWQDVTGKAKEKAIAIGVGIGSGYMYETTFQKEVYSDLYGERGVLMGGIQGLFLAQYQVLRKNGHSPSEAFNETVEEATQSLYPLIGQKGMDYMYNACSTTARRGALDWAPIFEKANVPIFEKLYESVRNGTETRKSLEYNSRTTYRQDLAKELAEIDNQEIWRAGKVVRSLRPDYKPE

SEQ ID NO: 3315 - protein, 416 aa, Agaricus bisporus
  source: /note="var. bisporus"
  source: /note="strain H97 / ATCC MYA-4626 / FGSC 10389"
MSLSNKLSITDLALTGKRVLIRVDFNVPIQDGKITNPARINAALPTIKYALDNGASKVILMSHLGRPDGKAISKYSLKPVASELEKLLKKPVFFLHDCVGPDIEKAVLEAPEGAVVLLENLRFHIEEEGSAKNEEGKKIKADPSKVTQFREQLTRLGDVYVNDAFGTAHRAHSSMVGIKLPQRASGFLVKKELDYFAKALENPERPFLAILGGAKVSDKIQLIENMLDKVNCLVIGGGMAFTFKKTLQNVAIGNSLFDKPGSEKVAGIVEKAKKNNVEIVFPVDYVVGDKFDANANHKIVTDDEGVPDGWMGLDVGPKSNELFRQAVLKAKTILWNGPPGVFEFPAFAKGSKVLLDATVEAVQKGATVIVGGGDTATVVANHDAEEKLSHVSTGGGASLELLEGKTLPGVAELSNK

SEQ ID NO: 3316 - protein, 403 aa, Agaricus bisporus
  source: /note="var. bisporus"
  source: /note="strain H97 / ATCC MYA-4626 / FGSC 10389"
MSTESPFKISVPDEQISLLKKKLELVRHPDELEEAGLDYGVPLKDMQRFAAYWKDGYDWKKHEAQLNEELPQFTRDIEVEGFGSLNIHYVHKKSTVDTAIPLIFVHGWPGSFLEVRKILPMLIEESSDHPSFHVVALSLPGFGFSEAPKKKGFAISQFAEVCHKLMLALGYNEYVTQGGDWGGIITQRISTLYGGKHAKARHTNFPTAPPPHPLHNPYNFFSNMLARYTPEEKAGLARMEWYYKESSGYYAKQSTKPQTLGYSLADSPVGLLSWIYEGLVNWTDNYPWTDDEVLTWMSIYWFSRAGPAASVRIYYEFTKSGGTLMTGGELGVPTGYSYFPKELVQFPRSWLKNKRLVFESRHEKGGHFASVEHPDLLVGDMRKMFGKGGPAFGVVPSHNGFKQ

SEQ ID NO: 3317 - protein, 426 aa, Agaricus bisporus
  source: /note="var. bisporus"
  source: /note="strain H97 / ATCC MYA-4626 / FGSC 10389"
MLASSLTRRSAASLNRNALRSVSVWSAVPAGPPDPILGVTEAFKADKNSRKINLGVGAYRDENGKPYVLPSVQKAEEVINTSKLDKEYLPITGLAEFTQRAAHLAYGAESVPLNNNAISAAQSISGTGALRIGGAFLARHYPTSKAIYLPTPTWGNHIPLFKDSGLDVRGYRYFDKSTVGLDFEGLKSDLRAAPEGAIVLLHACAHNPTGIDPTPEQWATISQIVKEKKLFPFFDMAYQGFASGSTDRDAHAVRLFVKDGHQVALAQSFAKNMGLYGERVGAFSLTTTDPEEKARVDSQLKILIRPLYSNPPCHGARIANTILGNQVLCDQWKGEVKGMADRIINMRERLYNILTHDLKTPGEWGHIKSQIGMFSFTGLTAPQTQVLAEKAHVYMTSNGRISMAGLNGSNIEYFAESVDAAVRGKL

SEQ ID NO: 3318 - protein, 446 aa, Agaricus bisporus
  source: /note="var. bisporus"
  source: /note="strain H97 / ATCC MYA-4626 / FGSC 10389"
MASYLARSFVRRFHVSARRSALSQFNMPAMSPTMSEGGIASWKKKEGETFASGDVLLEIETDKATIDVEAQDDGILAKIIAPDGSKNVQVGAPIAIVAEEGDDLSGAASLAEKASKQASAAKEEASPEPPKEEKPAPPPTPSSKPAPETKAELPTGDRIFASPIAKKIALERGIPLAQVKGTGPNGRIIRSDVESFSPAAATTSQPAAAESTADYVDIPLSNMRRTIGARLTESKQSRPHYYLTVDINMDKVLKLREVFNKTLTEKDKTSKLSVNDFVVKATSCALADVPEANSAWLGEVIRQYKKADISVAVATPSGLITPIVKDVGSKGLATISAETKTLAKKARDGKLSPSEYQGGTFTISNLGMYDISHFTAIINAPQSCILAIGSTQATLVPAPEEERGFKTVQIMKATLSSDHRVVDGAIGARWLAAFKGYLENPLTFML

SEQ ID NO: 3319 - protein, 430 aa, Agaricus bisporus
  source: /note="var. bisporus"
  source: /note="strain H97 / ATCC MYA-4626 / FGSC 10389"
MARLAPIICDNGTGFSKIGFAGNSDPSFVFPTAIATRGSPSQTSRAPAVPAKPGHLASKRGVEDLDFFIGDEALANAKTPGYGVHYPIRHGMIDNWDYMERYWEQTIFKYLRAEPEDHYFLLTEPPLNPPENREQTAEIFFESFNIQGLYIAVQAVLALAASWTSNKVTDRTLTGTVIDSGDGVTHVIPCAEGYVIGSAIKHIPIAGRDISQFVLNLMRERGEMTNVPPEDQLRVAGKVKENYSYVCQDIVREFRKYDEDPSKYFERYEGEYSVTKKKYGVDVGYERFLAPEIFFNPEIYSSDFLTPLPDIVDDVIQSSPIDVRRGLYKNIVLSGGSTMFQHFGNRLKRDLKQLVDRRLDTSALSSGSSMKSSGVEVEVISHKRQRYAVWFGGSLLASLPDFYTSCHTKAQYDEIGPSICRRYQIFGSAT

SEQ ID NO: 3320 - protein, 460 aa, Agaricus bisporus
  source: /note="var. bisporus"
  source: /note="strain H97 / ATCC MYA-4626 / FGSC 10389"
MSQQERTRVAIVGAGIVGLTLAIALNAFDKERKLAIDIYENASELAEIGAGINVWPRTLAIFKQIGVEDALIPLLDHIPDLEPRIIFGIRKGDEKNGYQVYDTMNNGGALRVHRAHLQNTLIQHLPLPGSKVTEINSICGFHLGHNLIDYSHHSSSGQGPLTLHFSDGKPSRTCDILVGADGIKSTLRHLFLPRLPNPEKYLNCYEPKWKGLLAYRGLVPKEKLEAVSPGHRALTHPGLMYSGKSAYAVVYPVSNGKFINVVAIVHDNPTNSTVWPGPWRMDVTQSEFFEVYKGWDEEVLDLIRCVDKPTKWALHALDHLDVYAKGRVFLMGDAAHAMLPHLGAGAHVGMEDAYILASLITHSSTPIWPSTQHVGEIANIYNTMRIPRAVSMSNSTDEAGYLCNLENPGLEEFKVGDHIPKELLIQTARTMEKKWAWTTTYADEDRIKAISLLEGPRAVL

SEQ ID NO: 3321 - protein, 463 aa, Agaricus bisporus
  source: /note="var. bisporus"
  source: /note="strain H97 / ATCC MYA-4626 / FGSC 10389"
MAEQPTKAKLWGGRFTGKTDPLMHEFNQSLKYDRRMYDADVRGSVAYAKALSRAGILTQDEMEKIIHGLSSVGKEWMDGIFQVKEDDEDIHTANERRLTELIGPLGGKLHTGRSRNDQVATDMRLWLLDEVRDVEQGLRALIRVMIERADQEKDYLLPGYTHLQRGQPIRWPHLLLSHAFSFRSDLERLQQLIPRISVLPLGCGALAGNPFAVDREFLAKELGFQHVAENSLWGVGDRDFIVEFLQWSSLTMVHISRMAEDLIIYSTAEFGFVTLSDAYSTGSSIMPQKKNPDSLELLRGKSGRIFGNMAGFLMTYKGLPSTYNKDLQEDKEPLFDAVDNVSASLKIAEGVIATLTVHPERMRQALTMDVLATDLADYLVRKGVPFRETHHISGRAVALAESRGCQISDLSFGDYKTLSEKFSEDIHKVFDFEASVERRESIGGTSRKMVERQVQVLRDVLAK

SEQ ID NO: 3322 - protein, 473 aa, Agaricus bisporus
  source: /note="var. bisporus"
  source: /note="strain H97 / ATCC MYA-4626 / FGSC 10389"
MSPIKVTKICCIGAGYVGGPTCSVIALKCPHIRVTIVDLNQARIDAWNSDDFNLPIYEPGLEDVVRQARGRNLFFSTDVDKAIEEADLIFVSVNTPTKKSGVGAGFAADLNYVELATRRIATIARSNKIVVEKSTVPCRTAESMRTILEANSKPNCRFDILSNPEFLAEGTAMTDLFKPDRVLIGSLQTPEGVSACQSLAQVYANWVPKECILTVGLWSSELSKLAANAMLAQRISSINALSAICEATGANIDEVSNAVGYDTRIGPKFLKASVGFGGSCFQKDILNLVYLSESLHLPEVAAYWRQVVDMNEYQKRRFSQRVVDTLFKTITGKRIAVLGFAFKADTGDTRESAAITLIKDFLSERAFVNVYDPKVVHEQIWMDLQEASPLVPLDNIKKQVTISPSAFEAAQGADAIVIATEWKEFRDIDWERLYKGMNKPAFVFDGRLLVDAEKLTKIGFKVTTIGRPSPLLT

SEQ ID NO: 3323 - protein, 486 aa, Agaricus bisporus
  source: /note="var. bisporus"
  source: /note="strain H97 / ATCC MYA-4626 / FGSC 10389"
MTSLADFSALIKGDVIVPGHAEYEKSLKRWAVNAEKKAAVVVFIKDEADAAAAILYARENDLPIAIRGGGHSPAGASSIDGGLVIDLSRYLTGVKVDPKKKLAYVGGGAIWETVDKTAIEHGLATVGGTVNHTGVGGLALGGGFGFLTGEHGLVVDNIVQVTLVSANGTIYTVNEKENTDLFFGIRGGGCNFGVVTELVLALHSQRRTVFTGPLIFPVIHLERVVEFAEEWYANIRSNEAMFLVLDGKPGTAPNIICHVFYNGSEEEGRSRFKGLYEIGPVMDMSKEIPYETVNSLQNSIIVPGSGVYWKGVAIPGPSYKPIANTYAKVQEISKSGTFSTLAVYELLPLQKINSVPLNTTAYRRSTNPNCLLSLNWPRDLNSQALVDEARSLTHQLAACVAGGASELEDEKSRPYANYGMNVYPLILYVIDDIGCMLDAEGDARSQEEVKKIAHVAFGDNYPALQKIKKIYDPDNIFNRWFSIIPA

SEQ ID NO: 3324 - protein, 486 aa, Agaricus bisporus
  source: /note="var. bisporus"
  source: /note="strain H97 / ATCC MYA-4626 / FGSC 10389"
MLHPAAPEAAVRLLKFVNASPTPFHAVNNASLRLEKAGFQKIKETDNWDHFVPGGKYYFTRSESINAISAVLTKNQAALVAFTLPKKWAPGAGLSIVATHVDSPNLKIRPISKRSKVGYLQVGVETYGGGIWHSWLDRDLSIAGRVVVAEQSGAFKSKLIKIDRPVLRIPTLAIHLDRNVNDNLKFNQETEFIPVLGMMESQLNAGRASDSDNDEPRKEPTTEASSIQDKHHPALLSLLSEELSVSPEKIHDFELSLYDTQPSVLGGIDNEFIFSPRMDNLFSSFCAVEALVEHPTSDLFPQVKGNVNAITLFNHEEIGSVSTSGALGSLLPMLLNRLSPTPQTYAQSVAQSFLLSCDMTHAVHPNYTSKHEDKHRPIINGGMVIKTNAKQRYATDAISSFIAKKMIERHGGKVQEFEVRNDMGCGSTVGPLLSQIGIRTVDVGAPMLSMHSIRETAGTHDVQASIDLFKSLFEGYPELNNNLTVD

SEQ ID NO: 3325 - protein, 504 aa, Agaricus bisporus
  source: /note="var. bisporus"
  source: /note="strain H97 / ATCC MYA-4626 / FGSC 10389"
MVFCAISGEPPQDPVVSLKSGHVYERRLITKYITENGSDPITGDKLEESDLIELKASPKTAPPRPPTQSSVPALLHTLQNEYDAIVLETFSIRQKYNSVRQELSYALYAQDAATRVVARLIRERDAAREALANIQASMGITPSAGAENGDVEMVEGESAEGLPAPVVAKIDETHASLSATRKKRKPPTDYASAAEVKTYAAKHTIPSLHSASPAGITSLVVSRLNPSQFLTGGNDKIVQLYDRSTDKVLASLKGHSKRINHVALREREGEQTLLLSAGADKIAKIWSQDSASGEYIANYTLRTHKGEISGLAVHPTSTLAVYSSLDKTYSVHDLTTFSQVFRSAPSEEALTSLAVHPDGTLIAIGTPASTIQIYDIRTCAIAATLTPSGGTPFTVNTLTFSENGYHMLAPDSVSSVSIWDLRKTRSTHSIPLGDDFKVTNVAYDHSAQFLGVAGNNGARIFAHKTWEELVRVEEGSEISGLAFGEQGKEIWTATGREIRIWGSP

SEQ ID NO: 3326 - protein, 528 aa, Agaricus bisporus
  source: /note="var. bisporus"
  source: /note="strain H97 / ATCC MYA-4626 / FGSC 10389"
MRLSSFQRLSTSLLYNSARSSVSIPNLFPYRFTLRMASSQTAVFGLKDSSLIKFQGYIDGKWVDAKSGETIPVTNPATDELLGAVPDMNVAETQEAIAAASAAFPKWSALSAKQRHDILIRFFQLMREHHEDLGRLITLENGKTLAEAKAENAYSASFLEWFAEEAVRTYGETIPSAIPGSRNVVIKQAVGVVSILTPWNFPSAMITRKLGAALAAGCTAVVKPPPETPFSALALAELSRRAGVPDGVFNVVPTLKYVNEVGKEMCQSKAVKKVSFTGSTNVAKLLYGLSSTTLKKVSLEAGGNAPFIVFDDANLDDAIEAALICKFRGSGQTCICANRIYVQSSIYAEFASRLADRVAKFKLGNGLESGTTHGPLIHNRAVEKVVRHVEDAVSKGAQILVGGKRQGDTSFFYPTVLSDVPAEAAINKEETFGPLAALIKFETEEEVVKMANDSDVGLAGYFYSRDVGRAWRVAEKLEVGMVGANSGVISQAVVPFGGVKESGLGREGSHGISEYLNTKLIVFGGIGA

SEQ ID NO: 3327 - protein, 502 aa, Agaricus bisporus
  source: /note="var. bisporus"
  source: /note="strain H97 / ATCC MYA-4626 / FGSC 10389"
MSNTEASQAGGAPSRVTLHLGHLPKKTDIKAPWPRTPTRVDPNNPPWPAYRGYHEYSFAHATMQSRLPTILGKAIEDAIRTLNDQAEEERVVDLSESIERMGGLMTDLSGNAKLRPIIDDSEADVALWNKEIAKYFQGKDFMNAPWLFAEAYKYRRLHECFSVSKFWKDYDVFYRQKCDTFSRSADAVFELSMRFAEPFKIAEGLSNQEELEAERLMFLELTQVCLWGNSTDLSLLINMSEEQIKALQSTGGDHLAATEKNILGNDLGRLWETVKELRQKTGGRIDFVLDNAGFELYCDMVYADFLLQSGLANQIHFHGKRFAWFVSDVTRKDWNWLLNTMVYGQLFPKASEEELESLRRLGRRWKQYEKEGKWVYEQHPFWCTGYTYWDLHSEAPDLFFHLSKSDLVIFKGDLNHRKLTYDCAAPASTPFDVAIGPMASAAGAPRIASLRTIKSDVVVGLGSEGDDVAEKLDETEPGWKISGKYAVVLLSDGRPGEKVRFA

SEQ ID NO: 3328 - protein, 546 aa, Agaricus bisporus
  source: /note="var. bisporus"
  source: /note="strain H97 / ATCC MYA-4626 / FGSC 10389"
MSLSRFPRPRHISSPARPFSTSARASAGLSPLARPVATEISAKWKGTSMTGGTTKNFIGGQFAESKTDKWLEAVDPSTQTLLSKVPQTTSQEFEQAVDAASHAFKSWSRTSVLTRQRFVLELQHLLRQNADAIAASIVLEQGKTLADAHGDLLRGLQVVETAASATTTLLGDKIEVSKDMDTYVRKVPLGVCASIAPFNFPAMIPLWTIPMAAVTGNTLIVKPSERDPGAAMIIAELCQRAGLPDGVLNIVHGQVPTVNAICDHPAIKAISFVGGDRAGKHIFDRGTQNGKRVQSNMGAKNHAILMPDANKNFALNSIVGAAFGAAGQRCMAASVAILVGEAQNWLPELKERAQKLKVSGGFEQGADLGPVISPQSKERITSLIASAEQEGGRIALDGRSITVPGYPDGNFVGPTILEADTNMKCYQQEIFGPVLVVLKADNLDDAIEIVNNNRYGNGTAIFTQSGATGRKFENEVQVGQIGINVPIPVPLPMFSWSGNKGSVLGDIGFYGKSGINFYTQNKTITSLWRAEDAVGNRASTAMPTHN

SEQ ID NO: 3329 - protein, 564 aa, Agaricus bisporus
  source: /note="var. bisporus"
  source: /note="strain H97 / ATCC MYA-4626 / FGSC 10389"
MPPLRAARLLTALALFSCGAQAISQVTRNGRYLYNADGSRFYIKGIAYQPQGFVIASDDNAFGEPTGFEDPLAQPDDCKRDIPFLQELSVNVIRAYSVNSSLNHDECMSALSNAGIYTIIDLSLPMNGSVDRSAPSWSGNLLDQYLETIDVFSKYDNVLAYNVGNEAITSNTTSVAPFIKAAARDVKAYLNSKSSSSLVAYAQIDGAENFRENVADYLSCDPTGQNSPSTAIDLFGLNNYEWCGDSTFEGSYAGLTSQFADYNVVAYFSECGCVSQPPRLWTEMDAIFSSQMSDVWSGSIAFSYFPAESVDGQYGMVTISSDGSTVQTSEDFDRLKQHYTAVSPPNSPSKDSAGASSYPSCPSSSDTFAASTTLPPTPDFAACSCLENALSCQFRPATSNYSAIVGELLDESCSLLGQSGGNCDELGANGQTGTYGRVSSCDPTIKLSYAMTSYYELNNRDAQACSFAGNGTVNSGSPASSASAAASSCITNAAAVFTPTLPAGGSNPGGSSGNGNGNGNGNGGGSSGNGDDTEPNSALVDAKPLLGVAAMIITSVVGGILTVV

SEQ ID NO: 3330 - protein, 537 aa, Agaricus bisporus
  source: /note="var. bisporus"
  source: /note="strain H97 / ATCC MYA-4626 / FGSC 10389"
MEAVPPYVGSSEVHHYPPAEPTNKFPELFPSHVGYAGATPTGAEPAIVATAPAWPLHSGAPQLVVPTQLMDSSKDGKGKGKKSKFNMLEKWGNLSPWYSVKRGAFGLDSGPETPDTCRTTGLHFLHRHGARYPTEWSEYGGPAKLARKIHESTQNWTGSGLLTFLNDWTYKLGAELLTPFGRQQLFDLGVTMRVKYGYLLQNFTESDTLPVFRTESQDRMLASAMNFAIGFFGWPHEDKYQQSITIEADGYNNTLAPYKTCPNAKTQSKAERAVWYLTRWADKYLNEAQKRIAKDIKGFDLTIEDVYTMQQMCAYETVALGYSKFCELFTEEEWEGFNYSLDLYFWYDSSFGSPLSRVLGVGWIQELVARLTHSPIAIHNTSTNSTLDDNSVTFPLDQSLYVDATHEVVVLHVITALNLTNFAEQGPLPYTHIPKDLKFHSSELAPFATNVQFQLLECTSVPGPQIRIIINDGVVPLTSIKGCPEQEDGMCPVDTFVEAMKEIIRDTDWNWGCHGDWDVPPGTEWNTTTGEPPKRGD

SEQ ID NO: 3331 - protein, 552 aa, Agaricus bisporus
  source: /note="var. bisporus"
  source: /note="strain H97 / ATCC MYA-4626 / FGSC 10389"
MTRFLLPLLLLGFTSFTGVNSFSPVIGPQGVNFWNLDKQEARERGASSRRDLPLEISARAFEEFEPQWFEQPLDHFDESNPHTFKQRYWVSKRHYKARQGAPVFVLDGGETSGANRLPFLDTGIVDILARATEGLGVILEHRYYGESIAVENLTTDALRWLNNEQAAADSANFMAKVKFNGIEEDLTAPSTPWIYYGGSYAGARSAHMKILYPDLVYGAIASSAVTHAAVENWQYMEIIRKAADPKCSHHLENSIKIIDSILLGHSKFFKSHLKGLFGLANLTHDDDFASTISSPLGSWQSKNWDPEESSVRFDQFCEALNAPVHGHGISAKATDLPFGDPARMVEVADGLTLDLSILNYGAYIKNNTASRCRTTLDDCFGTYDDSKYQQTGLDEDWRLWMFQVCTQWGYFTTTPPDPKQPRILSRLITLPHESKICQQAYLPGDFFQVPPLPNVTAVNMLGDFDIVADRLMFVDGEVDPWRPDTPHSDGAKPRDDTILRPFKLIPGAVHHWDENGLADVTQEPVVIQDIHAEEVAIIEQWLADWKPPTKKD

SEQ ID NO: 3332 - protein, 592 aa, Agaricus bisporus
  source: /note="var. bisporus"
  source: /note="strain H97 / ATCC MYA-4626 / FGSC 10389"
MPDNVDAEFLFPTPSPPPSSLSPYHSPGISPASTQALIAALTENHKRWHIFFNDKGFHNHTSHHLLAIWGLGVDAAIIKAAYENDLKTQRPAFKSPEPITEGNYEKHLGDEKFYDAYVNFFTDYARKNGTRDMLQTFIFSKKYNTEQMGMLNRFLSGLVHPMIHTGYGAEFNLPGMLIEGIAQACVHKTNVTELLPQSFFDSVLSIPETVSSTFLGGATQRIAQFAAQFAQGRSSSSSNDVHALTILARVMADSRLSLPDDLDTGNVIQKTIAKHSQLIREYVSQWTIDVSKAGEIERKVEEIAWTNVVMYGIAGWTWAQQVKQGSEGEFNADFFLMHLVTSAAFIPSLLARLDSVQHQVLLLRSYFAVCLSWYIARARPKFDVRAFFLSSTATPHPLPIHALPTPHEDALQGSDKIQTQVPDPWLPLVSTTIVHPDEHLPKTIRALASWASKFGSTPAGTFGGPSSGSSAEPAASKNAIKTELPGAEYLDGTLFVRVAGLTVARVELVRVKRRLSFGIGRDSLRMLEGRRKATIEHVFLGPLDVSCRSFSFFGVPFVAALVSCCTIPCRSRMNESMHPTSFGPQKRQGSHE

SEQ ID NO: 3333 - protein, 613 aa, Agaricus bisporus
  source: /note="var. bisporus"
  source: /note="strain H97 / ATCC MYA-4626 / FGSC 10389"
MMSSVSSRDKKESQDHDVELQPRLELANNVQARIQNPLYGIPREKLLQQVDDFTREYGFEDRSELFRKAAILAQSPKKFEEMPELTEDEKEAIRRETTHRWSQPRALYMTVFICSLAAAVQGWDQEGSNGANLSFPEEFGLTSQGDLGDWIVGIINAGPYMASAIIGCWLGDPLNYYLGRRGTLFWCGIFCTISVIGSGLAQTWPQLFVCRLLLGLGMGPKATTAPVFAAENVPANVRGGLVMSWQLWTAFGILLGVTANLILYQVGPIAWRLQLGSAFIPAVPLTIGVWFCPESPRWYMKKNRYQDAFKSFLRLRNTELQAAKDLFYVHRQLIEERSALKGSTYLGRFFDLFTVPRLRRATLASWVVMIAQQMCGINIIAFYSSTIFKESGFSERDALLASFGFGLVNWLFAFPAVFTIDTFGRRNLLLFTFPNMAWTLLAAGFCFLIRTGSPAKVPLVSLFIFLFAAFYSPGEGPVPFAYSAEVFPLTHREMGMGWAVATNLFWASVLGITFPRMLRALTPTGAFAFYAGLNVLAFVMILFLLPETKQRTLEELDYVFAVPMRKHVSYQLTEFIPYWIRRYVFWNKNVELRPLYNFDEVESITVFEKGAGH

SEQ ID NO: 3334 - protein, 667 aa, Agaricus bisporus
  source: /note="var. bisporus"
  source: /note="strain H97 / ATCC MYA-4626 / FGSC 10389"
MFTAARSLRFTATRSGRYAVIPPSMTRRNLNSKVNGPVIGIDLGTTNSCVAMMEGQTARVIENSEGARTTPSVVAFTKHGERLVGLPAKRQAVVNSHNTVFAFKRLIGRQFKDKEVKDDMRHWPFKVVPTADGRPAVEVENGGKKQTFSAEELSSMILTKMRSTGEEYANKTINHAVITVPAYFNDAQRQATKDAGQIAGLDVLRVINEPTAAALAYGSERADNSVIAVYDLGGGTFDISILEMQKGVFEVKSTNGDTHLGGEDFDIVLVEYILDHFKKEEGMDLRGETMAIQRVREAAEKAKIELSSTSQTEINLPFIAANAAGAKHINMKINRSQFEALVQPLVQRTIDPCKKALADAGVKASEVNDVILVGGMSRMPKVQDTVKSIFGRDPSKGVNPDEAVAIGAAIQGGVLAGNVTDILLLDVTPLSLGIETLGGIMTKLINRNTTIPTKKSQVFSTAADGQTAIEVKIFQGERELVRDNKLLGNFNLVGIPPAPKGVPQIEITFDIDADGIVHVNAKDKATNKDQSMTIASSSGLNDKDIEKMVADAEQYAETDKARRNLIEEANKADSICVDTEKAMNDFKDQLDASEKEKVTKLVGELRELAAKGQTGDASITADIIREKISETQNASLGLFQKVYEKRAAESSSSSSESSEPPKEEKKD

SEQ ID NO: 3335 - protein, 756 aa, Agaricus bisporus
  source: /note="var. bisporus"
  source: /note="strain H97 / ATCC MYA-4626 / FGSC 10389"
MVPESVKKIGKKVVDYPEHGVEVISVKDWSSSFRTNPLPHIKSYILGLFPILNWITRYNIGWLSGDIVAGLTVGIVLVPQGMSYAQIATLPPEYGLYSSFFGVLLYCIFATSKDVSIGPVAVMSLTVGNVIKHVQERHPGEFDGPTIATGLAFICGFIVLGIGLLRIGWIVEFIPMPAVSGFMTGSAISIAAGQVPGLMGIAGFDTRAATYQVIINTLKGLPRTKLDAAWGLTGLVSLYIIRYVCTWCSKRWPRRARLFFFLSAMRNAFIIVVFTIAAWLYCRTRRDSNGNYPIRILKDVPAGFKHIHSPRISSSLVSAMAPELPVATIILLLEHIAISKSFGRLNGYKINPNQELIAIGVTNTVGSCFGAYPATGSFSRSALKSKSGVRTPLAGIFTAMVVIVALYGLTQAFFWIPNAALSAIIIHAVADLVASPDQVFRYWRVSPLEFFIWLAAVLITIFSSIEHGIYTSIAASVALLLIRLAHPRGQFLGKVSLESDSGDEKDKREIFVPIKQNNINNPHIKVSPPAPGILIYRFEESYLYPNCSIVNSALVDYVKENMRRGKDIGAVKLRDRPWNDNSPRRNSAQEQAINEKKPWLHAIILDFSTVSHIDTTAIQSLIDARSEIERWTDYPVEFHFATILSPWIRRALVAGGFGYGNTHSKVPREVAAVVPYRGGRLPDDSSVEPVSDVESGDSKADIGIAEKDVELRRWEPVMPDVTPFFHIDLTSAARAAESGLNRLSKLDMVKPVLSAD

SEQ ID NO: 3336 - protein, 876 aa, Agaricus bisporus
  source: /note="var. bisporus"
  source: /note="strain H97 / ATCC MYA-4626 / FGSC 10389"
MTLSFKGHTVVVTGAGGGLGKAYSLLFASRGANVVVNDFNAAAAQKVVDEITQAGGKAVANTSSVTDGAAVIKTAIDNFGTVTILINNAGILRDKGFKNMSDKEWDQITEVHLKGAFSCTKAAWPHFRKQKFGRVINTASAAGLYGNFGQANYSAAKMGLVGFTLTLAREGAKYNIKSTAIAPIAASGMTETVMPPEMLANLSPAYVAPFVVAVCHPDGPDASGKIFELGAGYIAEVRWERSNGTIFKTDSTFTPTAGLLESAKKSPQNAQSGPEVRYDGQTVIVTGAGAGLGRSYALMYARLGANVVVNDVSEKGANAVVAEITQSGGKAIPAVFSVEDGEKIVQLAVEKFGAVHVLVANAGVLRDKSFLSMSEQEWDLVIAVHLRYCAKAVWPIFQKQKYGRIVTTASQVGIYGNFGQANYTTAKAGIIGLTRSLAIEGAKYDILVNAIAPSAGTAMTSTIWPQEMVDAFKPDYIAPVVGYLTSKDNTGTSGCLFEILGGWAAQTRWQRAGGHGFPHTKPYTPEDVVAKWDVITNFDDGRATNPSSTSEAVESIVSNFENKGDESLKAKLTMSVFKNTDAFADPEDAQLVADAKKIIPDPVPYTYTERDVILYNLGIGATEKELQWIFEGDDEFGALPTFGVIPQFPATSGVPLDFLPNFNPAKLLHGEQYMSIKAPIPTSGSLVTEARILEVLDKGKAAAVTAIAETRDTKTGQVIFENQSTVFIRGSGGFGGKRVGKDRGPASASNAPPKRAPDAVAEEKTSPTQAALYRMSGDLNPLHILPEFAAIGGFDKPILPGLCTMGIAAKHVLKTYGPYKDIKIRFAGVVYPGETIVTEMWKEGSKVIFTAKVKERNATALAAAAVTLVQEPKAML

SEQ ID NO: 3337 - protein, 884 aa, Agaricus bisporus; identical to SEQ ID NO: 840
  source: /note="var. bisporus"
  source: /note="strain H97 / ATCC MYA-4626 / FGSC 10389"

SEQ ID NO: 3338 - protein, 837 aa, Agaricus bisporus
  source: /note="var. bisporus"
  source: /note="strain H97 / ATCC MYA-4626 / FGSC 10389"
MSDEYPSLFRSEQMSLVQLFVPTEVAHDTVAELGELGDVQFKDLNPNVNPFQRSFVGEIRRVDEMARRVRFFAAQIEKEKDPIPLRPLYDSAPLITVGPRAAQTMDELDTVLTEHETKLTRMNENYNTLTERLKQLIEARYVLRETAVFFDRAQSHTTDIRTSFDDSAAPLLQHDDQESQFAPGDVQFDLEFVAGTIDRARVATFERVLWRVLRGNLYMNQTDITEPFVDPDSGTETWKNVFIIFAHGDVLLSKIRKIAESMGATLYPIDANADKRADALREVTARIEDLQTVLYNTGLTRRGELVRIGESLRSWQDVVKKEKLIYETLNLFNYDVRRKTLIAEGWVPTRDITNIQLALRHATEEAGTSVPPILHELRTHKTPPTFNKTNKFTEGFQAIMDSYGMAKYQEVNPGLFAIVTFPFLFAVMFGDIGHGLIILSAAIYMILNERRLARSDLGEINGQFFFGRYIILLMGLFSIYTGLMYNDIFSKSLHIWHSGWTFTEANGTITGESNGHTYPFGVDPGWHGADNALLFTNSYKMKMSIVLGVIHMTFALCLQLPNHIKFKRPVDIWANFVPQMLFLQSIFGYLVVCILYKWSIDWSTATTQPPSLLNMLIAMFLSPGTIEPGTQLYRGQSFVQIILLLIAAICVPWLLIAKPFVIWKEMKKIQGQGYVGLAHGEDIPREHSDDTLEGEEEGNGRAIVEDDKEGDEHEDFSEIVIHQTIHTIEFCLGCISHTASYLRLWALSLAHAQLSEVLWSMTIENFLGPNSILGWVFLIVVIGLWFGLTVFILCIMEGLSAFLHALRLHWVEANSKHFEGGGYAFTPLTFADLETKE

SEQ ID NO: 3339 - protein, 901 aa, Agaricus bisporus
  source: /note="var. bisporus"
  source: /note="strain H97 / ATCC MYA-4626 / FGSC 10389"
MPFNLDNIAALSNQHPKPTYYQYQYGTAGFRTLGDRLDSVVFRIGILAALRSMKHNSHAIGVMVTASHNPEQDNGVKLIDPRGEMLEASWEVHATTIANARTTEELVNVIQHIIDVVNIDTTRPAVVIYGRDTRPTGESLVAALQDGIRAAGADGRDAGITTTPIIHYLVRATNSKDFGEPTEIGYYTKMIDAFKKLVAGRPKISPLLVDCANGVGYIAADKVKKYLGDTLSLILENTSTATAGALNNSCGADYVKTTQRLPPSLNGKLTPVQRGCSLDGDADRLIYFYIDEKRQFRMLDGDKIASLVATFIVDLVRAAGLQGQIKVGTVQTAYANGSSTKFLAQRLPVKCVPTGVKYLHHAAESFDVGVYFEANGHGTVLFSRNTQETLEKHEPKTPAQQTALNHIINLTKLINQTVGDALSDMLLVEVVLAHRSYTGVEWDSLYTDLPNRLVKVVVNDRNAFVTTDAERRLVSPPLLQQRIDELVLKYDGGRTFVRPSGTEDVVRVYAEASTRVQADDLAYRIAGMVYDEAGVAICLAPTAHPLFLLSMCRFVIYKGTSPVQLSHLLTRPCHSIINQAFDSRLRLDRRRPMNGDGFGVGWYDSVYDPELGGQPCIFTSVTPAWNNANLARLAVKIKSPLVFAHVRATTAGSLSLDNCHPFAYENLMFMHNGNIADFHLFKRRLQADLPDHLFSFVQGNTDSEWSFALFLSKVPDPNARSFSPEILRNAMLETITSLNQYAEDAGVTEPSLMNFCVTDGSSIVVSRYISSRKDEAASLWFSSGTEFNEYAEGGHYRMSKSDKRENIIMIASEPLTFERADWMEIKTNHLVVITPKMNLLQIPIEDKYFVSPSDPASLARDTDFAEEKGLLNPLTRQSKLAHDAAATAHESPFKRQVTAEH

SEQ ID NO: 3340 - protein, 896 aa, Agaricus bisporus
  source: /note="var. bisporus"
  source: /note="strain H97 / ATCC MYA-4626 / FGSC 10389"
MGDFKPSPNSSQTRIDNYGDPFADRPRQTQFVEPERPYGSSASARPFESSASLPQDLGGGFDDEEYVEKLPLNTGGNFAGGFYPPGPVDPSAYGDSHIHPGRPSSVVSTSTNGVDSAWRRRQTIKRGVTRKVKLTQGNFIAEYPVPTPILNAVEDKWKSTNKTEFSHMRYTAATVDPDEFSEENGWSLRTKMYNRDTEILIAVTSYNEDKTLYARTLHGVMLNIRDICKTKQSKYWRRHAEEGTPGWQKITVALIVDGLEPMDKTVLDILATIGVYQDGVMKKQVDGKDTVAHIFEYTTQLSVDATPQLVLPRAEDPNNLVPVQIIFVLKAQNQKKINSHRWLFNAIGRMLNPEICVLIDAGTKPGHKSIYYLWEAFYNDPHLGGCCGEIHAMIKGGKKLLNPLVAAQNFEYKMSNILDKPLESSFGYVSVLPGAFSAYRFQAITGCPLEQYFHGDHSLADRLGPKGIYGMNIFTKNMFLAEDRILCFELVAKAKDRWTLTYVKPSKAETDVPESAAELIGQRRRWLNGSFAASVYALVNFFKLYRSGHGIIRMFFLHIQGLYNVFSLIFSWFALANMWLTFSIIIDLVPSQGIVIFGTETVTHWVNLSFKWLYLSFLALQFILALGNRPKGERMAYVATLWVYGFLAVYLLVCSFALTIKAFKNIPNELSFEGKSAGEIVLQFFEPPVGALIAAMISTYGIYLVASFLYRDPWHMFSSFLQYLCLAPSFTNVLNVYAFCNLHDVSWGTKGSDKAEALPSVSSSKTKGADMAVVEDTTKIQEDVDAAFKETVTRAITKIESKEVVEKPTMDDQNKTFRTRLVSLWMLSNATLAIAIENISGLPSKDPSVDADTLQKRQSTYFAIILYSTFGLAMVRFIGCLFYFFKRNLFRCCRKN

SEQ ID NO: 3341 - protein, 926 aa, Agaricus bisporus
  source: /note="var. bisporus"
  source: /note="strain H97 / ATCC MYA-4626 / FGSC 10389"
MRGRGAPDRGRGGGYGGARGTPSRGRGGNRGRGSAGGGRGVPAGIYSPPNRPIAIDARLRDGSQKQVMAGLKSAPINEKGLPLRLDLGTKGREIALRTNYFAMTIPKGPFYDYEVVTTPAVSIRRVRRRIFEIAEDTEPWKKILAGCVAHDHSAKLVASKLLPQPLSIDVPFYEEDDDPPAKGSQPRKMYTLSIKFARELETESLRKVIAGDPQYSAHDIMPIISAFNLILAAWPTRSGAGGVMVGRNKFFMPGTGVPMPLGGGLEAVRGFYSSVRTAHQALMVNVNVCTTAFYRSGNLATALIEFLKINSRPTTFVKGLRVKATHLGYRKTIKEATEYTAKTYVFKTEDYGEISVEEYFLKRYKIKLQHPNLPLVDVGGQKVNYLPTELCEILPNQPYRGKLLDEHTAAMIRYAAQPPNANAHAIETQGLKELGFTQNAPTLNAFGVGISQAMATVPGRVVPPPKIKYKGEKELDGRSFRSDKASWNLREVKFVKGATLAKWAVLLIRDGSHTEFNGPSDPELRSALKSFSEVCGKSGLNITSLPTIAEVHLPPYDRTDLGRGKAIHIIHSMLPKMFNQKPQIIFTILSNTDKHIYSGLKRLFDVTLDLPSVCAQAERLRNGGPQYYSNVSLKFNMKLGGVNHVLDKTSVTWLGEMPTMVVGIDVTHPGVIAVKGTPSIAAVVASVDRDCVQFPASLRRQESRKEMVTDLKEMMIERLNAFHSKSGRYPERILIYRDGVSEGQFASVIEEELPAVVEACRAVKMKSRPKLTIVVCAKRHHTRFFPTSEKDVDDKFNPLPGTVVDQGVTTVYNFDFYLQAHGSLQGSSKPTHYFVIHDENGFIPDKLQALTNSISYMFARATKAVSLVSPAYYADLACERGRCYLHELLNGIRSGPIDEEKAWKDAAKYWGNGPTGSAMKNIMFYL

SEQ ID NO: 3342 - protein, 1012 aa, Agaricus bisporus
  source: /note="var. bisporus"
  source: /note="strain H97 / ATCC MYA-4626 / FGSC 10389"
MLSRRVVVGRLSTLARASRSLRPTPPPLIRRGYALARGPSHNDPFANGTNAYYADEMYRLWRQDPKSVHTSWDVYFSGLDQGMPSHHAFQPPPTTHLPHPADGAPALHAGDGAELNDHLKVQLLVRAYQVRGHHVAELDPLGILDTDLADVRPPELELSRYGFTERDLEKDITLGPGILPHFATEGNKTMKLKDIIRTLKRIYCGHVGIQYVHIPDKEQCDWIRERVETPKPWNYTVEEKRMILDRLIWSESFEKFMASKYPNEKRFGLEGCEALVPGMKALIDRSVETGVKHITMGMPHRGRLNVLANVIRKPIEAILNEFSGDEDDNWPAGDVKYHLGANYVRPTPSGKKVSLSLVANPSHLEAADPVVLGKTRAIQHFENDEIAHTTAMGVLLHGDASFAGQGVVYETMGLHSLPSYGTGGTIHLIVNNQIGFTTDPRFARSTPYPSDIAKSIDAPIFHVNGDNVEAVNFVCQLAADYRAKFKKDVVIDIVCYRRYGHNETDQPSFTQPRMYEAIKNQPTPLTKYTKFLVGRGTFTEKDIEEHKKWVWGMLETAANGAKDYVPTSKEWLSAAWTGFPSPRQLAEQALPTRATGSDVPTLRQIGKAISTFPQGFTTHRNLARILNARGKTVEEGTNIDWSTAEALAFGTLALEKIHVRLSGQDVERGTFSQRHAVIHDQANEQQYVPLNDLGSNQARFVVCNSSLSEFGTLGFELGYSLVSPDSLTIWEAQFGDFANNAQCIIDQFIAAGERKWLQRTGLVVSLPHGYDGQGPEHSSGRIERFLQLCDDHPHIYPSPEKIERQHQDCNMQVVYPTTPANYFHVLRRQIHRDFRKPLIVFFSKSLLRHPKARSSLDEMVGETHFERYIPEASEDLVAPDQVKRHILCSGQVYYALLQAREERGIKDVAISRIEQLSPFPYDMVTSHLDKYPNADLLWCQEEPMNNGAWTYIGPRIYTAASRTQNHKGKYPYYAGREPTSSVATGSKTQHKKETEAFVNTAFDTWTEMHHLK

SEQ ID NO: 3343 - protein, 1048 aa, Agaricus bisporus
  source: /note="var. bisporus"
  source: /note="strain H97 / ATCC MYA-4626 / FGSC 10389"
MATLPPDGPNPNSKSAAKKEAKRLEKEAKLAAKNAKTAATVPKAKDAAAGKKAKAKDDETEFVNTTPKGQKKDVSGPMPAGYNPLAIESAWYDWWLESGFFKPQFDKDAEGNPTIKPAGLFIIPAPPPNVTGSLHIGHALTVGIQDALIRWNRMLGKTTLFAPGFDHAGISTQSVVEKRLYKLEGKTRHDLGREKFLEQVMDWKNDYQDRITKQLYRLGGSYDWNRTAFTMDPKLSKAVIETFCRLHEDGIIYRANRLVNWCVKLNTTLSNLEVDQKQLNGRTFLNVPGYDAKEKFEFGVITSFAYPIENSDEKIIVATTRPETMLGDTAIAVHPDDPRYKHLHGKLAVHPFVPGRKIPIVTDSIIVDMEFGTGAVKITPAHDPNDYDVGVRHSLECINILNDDGTLNANAGEKFKGMKRFHARVAVVKELKELGLYVDTKDNPMQIPLCSKSGDVIEPVLKPQWWVNCKPLAEEAIRRTEAGELLITPKTSENEWYRWLEGIQDWCISRQLWWGHRCPAYFVRIEGRDQDVNDGKNWVVGRTLEEATERAKVFANGAPFTLEQDEDVLDTWFSSGLWPFSIMGWPDQTADLKTFYPSSMLETGWDILFFWVARMVLLGIHLTGQMPFKEVLCHAMIRDAHGRKMSKSLGNVIDPTDVIQGLPLEALHEKLYEGNLDEKEIAKAKDGQKKDFPKGIPQCGTDALRFALCAYSGGGRDINLEILRVEGYRKFCNKIFNATKFAMLKLDESFVPQPNNKPTGKESLVEKWILHKLNVAATEINQHLTDRNFMAATTSAYNFWLYELCDVYIEAMKPMTDEAAPLETKKSAQQTLYMCLDYGLRLLHPFMPFVTEELWQRLPRMPNDSTPSIMLSSFPVADSAFEFEEADKQFDLIFSTLRAGRSLAASYNLLNNIQLFIHVRNDSEAALFEPQLATIIALTKGGKSAQVVRSSSEIPEGCGASVVTSSVTVHTLVRGLVDLDVEIGKCDKKLDVARMNHAKIVKTESQADYAKTVPENVRLANEDKRKTIEAEVATLESSREMFRRIQLQ

SEQ ID NO: 3344 - protein, 1485 aa, Agaricus bisporus
  source: /note="var. bisporus"
  source: /note="strain H97 / ATCC MYA-4626 / FGSC 10389"
MASLEDYDEFGNYIGADLDSDAEDEELNQGQYAPQPSGAPAPLEGFDDEPMQEPENEMALMEVDDEPRHKAVVLHEDKQYYPTAGELYGADVETLVQEEDAQPLSEPIVAPIKIRRWTVEEKDMPETRFDKGFLLNMTAFPEMIRNVAVVGHLHHGKTALMDMLVFETHKLIWDADKPTRYTDTHVLSREREISIKSSPMSLVLQTTSGKSHLLHLIDTPGHVNFLDEVAAAIRLADGILLVVDVVEGLMVGAEYIIRHALQENLKITLVVNKIDRLILELRIKPADAYYKIKHTIEEINTFISNIDPDPELRLSPENGNVAFASTDMNYCFTLRSFAKLYADTYGKLDVNAFAARLWGDIYFDEESRRFTRKQSDPEQNRTFIHFILNPLYKIYSNVLSEDTDALRETLASLGITLKPVIYKMDVRPLLKVVLDQFFGNSTGLVDVIVEHIPSPVENAANKVEGIYTGPQTSELAVSMKSCDPEGPVMVHITKLYHTTDAQSFRAFGRVISGTLRKGAEIKVLGEEYSPEDEEDMMKATVEDLWISEARYFIPAEEVAAGNLILIGGVDASISKTATIASTSIDDDLYIFRPMKHMTESVLKVAIEPIAPSELPKMLAGLRSINKSYPLISTKVEESGEHVMIGTGELYLDCVMHDLRRLFSEIEIKVSDPVTKFCETVLETSALKCYADTPNKKNKITMIAEPLERGIAEDIERGRVTMKMTAKDRGKFFEEKYQWDLLASRSIWAFGPYDNGPNVLLDDTLPSQVDKKLLGTIKEHIKQGFQWGAREGPLCDEPMRNVKFRLLDADIAQEAIFRGGGQIVPTARRVCYSSFLMASPKLMEPVYYVEVQAPADCISAVYTVLARRRGHVTQDIPKAGSPLYTVKALIPVIDANGFETDLRTATQGQAFCLQIFDHWSAIPGDPMDTSIKLRPLEPASGQALARDLVLKTRRRKGLGDQIAVSKYLDDEFVPTEIKAPFLEQFTEDWADRWTASEATKKNNAGSETFSYVGKWKVEEATKSIIKGDHGLVAKSPASHHAISAPFKKPIDFKQKPLVVQYEVNYQKGGSCGGGYIKLLEDGFQSSGQDFDDKTPWVVMFGPDLTCPGTKVHFIVRHKSPMTEEIEEKHYTGHPRFLVEKYTNLHTLVLHPNNTFNIYLNGELDKTGNLLEDMQPPVNPPTEIDDPSDSKPDDWVEDDRIIDIHATKPDDWDEDAPRRIPDDEAEKPEGWLDDELPHIPDPDATKPDEWDDEEDGDWVAPTMPNPKCDNAPGCGPWERPMKNNPNYKGRWSAPLIDNPDYKGPWAPRKIPNPNYFEDPTPVKSLPKIGGVGIELWTMTEDILFDNLYIGHSLEHAKKLAAETFDIKKPLERLAASVIEKLEGKDDEDDDDEVSFKDDPVSFIRNRVLSFVENVKEDPIEAFKTQPETGVALLVTLFTIFGMFSGFLGFGGASAKPVITQTAKKADTSEKKSETTSDDKKDDLKKRK

SEQ ID NO: 3345 - protein, 1590 aa, Agaricus bisporus
  source: /note="var. bisporus"
  source: /note="strain H97 / ATCC MYA-4626 / FGSC 10389"
MPEADIFKVPILGKDSIHCGFHLIPYIAHTVISTLPSSTYVLITDTNIAKFHLKSFEDVFQSTLDTHDASGAKPRFISLVIPPGETSKSRDGKAQIEDFLLLNKCTRDTVVLALGGGVIGDLVGFVSATFMRGVRFVQIPTTLLAMVDSSVGGKTAIDTPHGKNLIGAFWQPEYIFIDAAFLETLPQREFSNGMAEVVKTAAIWNENEFLSLEARSAEIFTAIQTPSENFAGRTKDTRSAAQELLLSVIVGSISVKAHIVTIDERETGLRNLVNFGHSIGHAIEAVLTPTILHGECVSIGMILEAELSRQMGILSQVGVGRLSRCLKAYNLPISVSDPRIANLPAARLLTVDRLLDIMRIDKKNSGNEKKIVILSRIGATYEQKATVVKDALIFKTLSEAAKVIPGIPSHNPVVMSTPGSKSISNRALVLAALGKGTCRLRNLLHSDDTQVMMAALGELKGAKFSWEDNGDTLVVEGGQGFLAVPPKGKELYLGNAGTAARFLTTVCTLVQASPKDNADVTIITGNARMKQRPNGPLVTALRTNGSQIKCLETEGCLPLAIAPEGLKGGTIQLAASVSSQYVSSILLCAPYAAQPVTLELTGGQVISQPYIDMTIAMMKTFGVEVKRRVDSASGKLLDTYDIPKAVYVSPPNYSIESDASSATYPLAIAAITGTSCTIDNIGTSSLQGDAKFAKEVLEKMGCTVSQTETQTTVQGPPIGGLKAIEEVDMEIMTDAFLTATVVAAVAHGKTRILGIANQRVKECNRIRAMIDQLAKFGVECIELDDGLEVIGKPIPELKRGASVHCYDDHRVAMAFSVLSTVVENTIIEEKRCVEKTWPNWWDDLENKIGIKVEGVDLAGLHAKASVSGTRNFDPSASVVLIGMRGVGKSFIGDLAANALGWPQLDADDYFAEVKKQALRDFVTEHGWPAFREAEVEVLGELLKEKATGHVISLGGGIVETPAARELIKQYASTTGPVVHVTRPLDEILAYLGAESARPAYGEPVADVYHRRHPWYTDISNYEFLNPVGASSVVTSPSAGVHEEVARFFKHITGQKPNLSSNVGAGKRSYFLSLTYPDITEALSIVEQISEGVDALELRVDLLKSSKESDAIPSTDYVASQLAALRRVTSLPIVYTVRTSSQGGKHPDKAEKEALELLELGLKAAVEYLDVEITLPEQKIRELASKKGRSQIIASYHDFSGNLKWNSVAVKEKYDIAEGLGDIIKIIGTANAIQDNFELHNFITSVNSKPNAKPIIAVNMGTQGQLSRILNETFTPVTHPLLPIKAAPGQLSFKQIQEALTLVGQLPAKQFYLFGNPISHSMSPTLHNTGFQVLGLPHKYSLLETQQFNEQNKEAIAAADFGGASVTIPFKLDVIPSLDELTPAAQAIGAVNTVIPTVSGGKRVLVGDNTDWIGIRKSIIAQLSTGVVGNGLVIGGGGTARAAIYALQSLNAETVYLWNRTKSKAEDLARAFPNARVQVLDRLGAWTSAPPNVIVGTVPASATTLEEGAPSATLLTADLYQYRDGPAVVVDMAYKPAQTPLLQLASVASNWKTVRGLDVLLEQGYEQFELWTGRRCPRKIVGEKVTEKYDA

SEQ ID NO: 3346 - protein, 180 aa, Linum usitatissimum
MADRTTQPHQVQVHTQHHYPTGGAFGRYEGVLKGGPYHQQGTGSGPSASKVLAVMTALPIGGTLLALAGITLAGTMIGLAITTPIFVICSPVLVPAALLIGFAVSAFLASGMAGLTGLTSLSWFARYLQQAGQGVGVGVPDSFDQAKRRMQDAAGYMGQKTKEVGQEIQRKSQDVKASDK

SEQ ID NO: 3347 - protein, 180 aa, Linum usitatissimum
MADRTTQPHQVQVHTQHHYPTGGAFGRYEGGLKGGPHHQQGSGSGPSASKVLAVMTALPIGGTLLALAGITLAGTMIGLAITTPIFVICSPVLVPAALLIGFAVSAFLASGMAGLTGLTSLSWFARYLQQAGQGVGVGVPDSFEQAKRRMQDAAGYMGQKTKEVGQEIQRKSQDVKASDK

SEQ ID NO: 3348 - protein, 347 aa, Linum usitatissimum
MDLIHTFLNFVAPPFTFFSLCFLLPPYFLFKTFTSAVSYVFSENVSGKVILITGASSGIGEHLAYEYGSRGACLVLVARREKGLREVVDLALELGSPQVIMIVGDVQKVDDCRRIVNETINHFGRLDHLVNNAGISSVCFFEDATDVTNFRTIMDTNFWGSAYITQFAIPYLRQTAGKIIALSSAGSWLPEPRMTIYNASKAAMVAFFETLRVELSPDIGVLIVTPGYIESELTQGKFMTAEGRMDVDQDLRDEKFGPIPVASVVSTAKGIVNSACRGDKYLTVPAWVRTTWLWKIFCPDAVELGYRLFFTSGRPGEPAPSKKMLDMTGAQGLMYPYSILNPAIKTV

SEQ ID NO: 3349 - protein, 536 aa, Linum usitatissimum
MASSALNNLVAVNPNTLSPSPKSTPLPNTFSNLRRVSAFRPIKASLFGDSPIKIPGITSQPPPSSDETTLPIRQIPGDYGLPGIGPIQDRLDYFYNQGREEFFKSRLQKYKSTVYRANMPPGPFIASNPRVIVLLDAKSFPVLFDMSKVEKKDLFTGTYMPSTELTGGYRILSYLDPSEPNHTKLKQLLFNLIKNRRDYVIPEFSSSFTDLCEVVEYDLATKGKAAFNDPAEQAAFNFLSRAFFGVKPIDTPLGKDAPSLISKWVLFNLAPILSVGLPKEVEEATLHSVRLPPLLVQNDYHRLYEFFTSAAGSVLDEAEQSGISRDEACHNILFAVCFNSWGGFKILFPSLMKWIGRAGLELHTKLAQEIRSAIQSTGGGKVTMAAMEQMPLMKSVVYETLRIEPPVALQYGKAKKDFILESHEAAYQVKEGEMLFGYQPFATKDPKIFDRPEEFVADRFVGEGVKLMEYVMWSNGPETETPSVANKQCAGKDFVVMAARLFVVELFKRYDSFDIEVGTSSLGASITLTSLKRSTF

SEQ ID NO: 3350 - protein, 375 aa, Linum usitatissimum
MERKFSPFVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIIKCDVDIRKDLYGNIVLSGGSTMFPGIADRMSKEITALAPSSMKIKVVAPPERKYSVWIGGSILASLSTFQQMWISKSEYDESGPSIVHRKCF

SEQ ID NO: 3351 - protein, 100 aa, Linum usitatissimum
HVTHETGSMCYIEEINKAEYCDRSRYPCAQGKRYYGRGPLQLTWNYNYQEAGKANGFDGVANPDIVARDPVLAWRTALWFWMTNVRAVLPQGFGATIRAI

SEQ ID NO: 3352 - protein, 186 aa, Linum usitatissimum
KGGAKKVVISAPSKDAPMFVVGVNEKEYKPELDIVSNASCTTNCLAPLAKVINDRFGIVEGLMTTVHAITATQKTVDGPSNKDWRGGRAASFNIIPSSTGAAKAVGKVLPALNGKLTGMAFRVPTADVSVVDLTVKLEKKATYEQIKAAIKEESEGKLKGILGYVDEDCVSADFVGDNRSSIFDAK

SEQ ID NO: 3353 - protein, 158 aa, Linum usitatissimum
MSLIPSFFGNRRSDPFSALDMWDPIRDFSSFNFPSSSLILGGGENSAFVNTRIDWKETPEAHVFKADLPGLKKEEIKVEVEEDRVLQISGERNVEKEDKNDTWHRVERSSGKFMRRFRLPENAKMEEVKAAMENGVLTVTVPKAEVKKPEVKAIEISG

SEQ ID NO: 3354 - protein, 169 aa, Linum usitatissimum
MAKLMSLAAVATAFLFLIVVDASVRTTVIIDEETNQGRGGGQGGQGQQQSCEQQIQQQDFLRSCQQFMWEKVQRGGRSHYYNQGRGGGEQSQYFDSCCDDLKQLSTGCTCRGLERAIGQMRQEIQQQGQQQEVQRWIQQAKQIAKDLPGQCRTQPSQCQFQGQQQSAWF

SEQ ID NO: 3355 - protein, 168 aa, Linum usitatissimum
MAKLMSLAAVATAFLFLIVVDASVRTTVIIDEDTNQGRGGQGGQGQQQQCEKQIQEQDYLRSCQQFLWEKVQKGGRSYYYNQGRGGGQQSQHFDSCCDDLKQLRSECTCRGLERAIGQMRQDIQQQGQQQEVERWVQQAKQVARDLPGQCGTQPSRCQLQGQQQSAWF

SEQ ID NO: 3356 - protein, 475 aa, Linum usitatissimum
  MOD_RES (145)..(145): Any amino acid
  MOD_RES (228)..(228): Any amino acid
  MOD_RES (236)..(236): Any amino acid
  MOD_RES (265)..(265): Any amino acid
  MOD_RES (276)..(276): Any amino acid
  MOD_RES (362)..(362): Any amino acid
MSHQTETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYXKTFQGPPHGIQVERDKLNKYGRPLLGCTIKPKLGLSAKNYGRAVYECLRGGLBFTKDDENVNSQPFMRWRDRFLFCAEAIYKXQAETGEIXGHYLNATAGTCEEMIKRAVFARELGVPIXMHDYLTGGFTXNTSLAHYCRDNGLLLHIHRAMHAVIDRQKNHGIHFRVLAKALRMSGGDHIHSGTVVGKLEGEREITLGFVDLLRDDFVEKDRSRGXYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEYEAMDTL

SEQ ID NO: 3357 - protein, 69 aa, Linum usitatissimum
SRRCPGKNAWPELVGKSGNMAAATVERENRNVHAIVLKEGSAMTKDFRCDRVWVIVNDHGVVTSVPHIT

SEQ ID NO: 3358 - protein, 106 aa, Linum usitatissimum; identical to SEQ ID NO: 636

SEQ ID NO: 3359 - protein, 413 aa, Linum usitatissimum
MAGLAPEGSQFDAKQYDAKMSELISADGQDYFASYDEVHETFDSMGLQENLLRGIYAYGFEKPSAIQQRGIVPFCKGLDVIQQAQSGTGKTATFCSGILQQLNYGLVECQALVLAPTRELAQQIEKVMRALGDYLGVKVHACVGGTSVREDQRILSSGVHVVVGTPGRVFDMLRRQSLRADSIKMFVLDEADEMLSRGFKDQIYDIFQLLPPNIQVGVFSATMPPEALDITRKFMNKPVRILVKREELTLEGIKQFHVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTTDDERMLFDIQKFYNVVIEELPANVADLL

SEQ ID NO: 3360 - protein, 146 aa, Linum usitatissimum; identical to SEQ ID NO: 619

SEQ ID NO: 3361 - protein, 155 aa, Linum usitatissimum
MDQTHQTYAGTTQNPSYGGGGTMYQQQQPRSYQAVKAATAATAGGSLIVLSGLILTATVISLIIATPLLVIFSPVLVPALITVGLLITGFLASGGFGVAAVTVLSWIYRYVTGGHPAGGDSLDQARSKLAGKAREVKDRASEFAQQHVTGGQQTS

SEQ ID NO: 3362 - protein, 221 aa, Linum usitatissimum
MGRRPARCYRQIKNKPYPKSRFCRGVPDPKIRIYDVGMKKKGVDEFPFCVHLVSWEKENVSSEALEAARIACNKYMTKSAGKDAFHLRVRVHPFHVLRINKMLSCAGADRLQTGMRGAFGKPQGVCARVAIGQVLLSVRCKDSNSQHAQEALRRAKFKFPGRQKIIISRKWGFTKFNRADYVKLKQENRIMPDGVNAKLLGCHGPLANRQPGRAFAPTATA

SEQ ID NO: 3363 - protein, 826 aa, Linum usitatissimum
MPISSIATVSGGGGGDADGALRNFKLNESTFLASLMPKKEIGADRFIEAHPEYDGRGVIIAIFDSGMDPAAAGLQVTTDGKPKVLDVIDCTGSGDIDTSKVVKADADGCIGGASGASLAVNPSWKNPSGEWHNYDDKGPVIDAVVWYDGELWRAALDTQNLEDNPECGKLADFVPLTNYRIERKFGVFSTVDACTAVLNIYDEGNILSIVTDSSPHGTHVSGIATAFHQEAEGITVSPYTVRKALENTSLYVGECLADKLTTGQGLMQVDRAYEYVCQSRDIPIFQYNIKVNQSGKSSHIERRFIEVPLGASWAEATVRVSEFDTTRRFFLDTLQICPLRRPIKWESVATFSSPGAKTFSFRVVSGQTMELAVAQFWSSGLGSHDTTIVDFEISFHGIDVTKEEIILDGSDAPVRIDTEALLASEKLSPVALLNKLRVPYRPVDSKLITLTGTRDKLPSGKQTLALTLTYKFKLEDGANVKPQVPLLNNRIYDTKFESQFYMISDANKRVYSVGDVYPAASKLPKGDYTLQLYLRHDNVQYLEKLKQLVLFIEKTLEDKDVIRLNFFSEPDGPIMGNGSYKSSELVPGKKEAIYLAPPAKDKLPKAEYPQHTPLLAKILEGLHSRSKIDDKIKHSQEVIATADEVISSVDKDELAKFFSYKPDPEDEEAEKMKKKMETTRDQLAEALYSKGLALSEIESLKNSDKTETEAGAEGNIDEWTDVRKEASEESGSKQDTFEETFKELQKWVDVKSSKFGTLYVLREKRRGRLGTALKVLNDMILEDGDPPKKKLYEMKLSLLEEIGWTHLTAYEKQWMHVRFPSSLPLF

SEQ ID NO: 3364 - protein, 262 aa, Linum usitatissimum
MARGLKKHLKRLNAPKHWMLDKLGGAFAPKPSSGPHKSRECLPLVLILRNRLKYALTYREVQSILMQRHVMVDNKVRTDKTFPAGFMDVVSIPKTNENFRLLYDTKGRFRLHSIRDEEAKFKLCKVRNIQFGSKGIPYLNTYDGRTIRYPDPLIKANDTIKLDLDSTKIVDFIKFDVGNVVMVTGGRNRGRVGILKNREKHKGSIETVHIQDSTGHEFATLLSNVFTIGKGSKPWVSLPKGKGIKLTIIEEAKKRIAAQAAA

SEQ ID NO: 3365 - protein, 142 aa, Linum usitatissimum
HQTQYGGTMQNQPQYQTKSYQAVKAATAATAGGSLLVLSGLILVATIIALTMATPLLVIFSPVLVPALITVGLLITGFLASGGFGVAAITVLSWIYRYVTGRHPVGADSLDQARMRITGKAREMKDRASDFGQQHVTGQQTS

SEQ ID NO: 3366 - protein, 260 aa, Linum usitatissimum
MARPILICVASLLLFSLLATVTARIPGVYTGGPWESAHATFYGGADASGTMGGACGYGNLYSQGYGVNTAALSTALFNEGLSCGACFEIKCDSDPRWCHPGQPSIFVTATNFCPPNFAQPSDNGGWCNPPRTHFDLAMPMFLKIAEYRAGIVPVSFRRVPCRKVGGIRFSINGFRYFNLLLVTNVAGAGDIVKVSIKGERTNWMPMSRNWGQNWQSNSVLVGQRLSFRVTGSDRRTVTSMNIAPANWQFGQTFTGKNFRV

SEQ ID NO: 3367 - protein, 270 aa, Linum usitatissimum
MSSTNETSPLPGLPIDLRGKRAFVAGVADDNGYGWAIAKSLAAAGAEILLGTWVPIKTNKRYAGSSNWTVKELAESVKQDFGSIDILVHSLANGPEVVKPLLETSRNGYLAAISASSYSFISLLQNFIPIMNPGGATISLTYIASERIIPGYGGGMSSAKAALESDTRVLAFEAGRKHKIRVNTISAGPLRSRAAKAIGFIDMMIDYSSANAPLQKEVTAEEVGNAAAFLVSPLASAITGTVVYVDNGLNAMGVGVDSPLFESLNIPKAN

SEQ ID NO: 3368 - protein, 293 aa, Linum usitatissimum
MKLNPLLSNLALYDIANTPGVAADVSHINTGSEVSGYVGDEQLGKALEGSDIVIIPAGVPRKPGMTRDDLFNINAGIVKGLCQAIAKYCPHALVNMISNPVNSTVPIAAEVFKKAGTYDEKRLFGVTSLDVVRARTFYAGKANVPVAGVNIPVVGGHAGVTILPLFSQANPKANLSDEEIVALTKRTQDGGTEVVEAKAGKGSATLSMAYAGALFADACLKGLNGVPDVVECTFVQSNVTELPFFASKVRLGKNGVEEILGLGPLSDFEKQGLENMKSELKSSIEKGITFANK

SEQ ID NO: 3369 - protein, 300 aa, Linum usitatissimum
MATDAAPPRALSARELDIQMMLAAEVHLGTKNCDFQMERYVFKRRNDGIYIINLGKTWEKLQMAARVIVGIENPQDIIVQSARPYGQRAVLKFAQYTGAHAIAGRHTPGTFTNQMQTSFSEPRLLILTDPRTDHQPIKEGALGNIPTIAFCDTDSPMRYVDIGIPANNKGKNSIGCLFWLLARMVLQMRGTIPQGHKWDIMVDLFFFREPEEQKQDQDEEPDYALAAPEFYGMAAGGDWNTPAADAQWTADAVQAPISGVPAAYIAEPTAAPIAGNWEPAPVPSPAFAPPASAASGWDEV

SEQ ID NO: 3370 - protein, 80 aa, Linum usitatissimum
VGCGRIGKLLLQRLKPFGCNLLYHDRLKMEPELETQIGAKFEEDVDAMLPKCDVVVINTPLTEKTKGMFDKDRILKMKKG

SEQ ID NO: 3371 - protein, 141 aa, Linum usitatissimum
MSSVAAAGSAKSGRGKPKSKAVSRSQKAGLQFPVGRIARFLKKGRYAERVGSGSPVYLCAVMEYLAAEVLELAGNAARDNKKTRIVPRHIQLAVRNDEELSKLLGGVTIANGGVLPKIHQSLLLKKAGKDKGDIGSASQEF

SEQ ID NO: 3372 - protein, 155 aa, Linum usitatissimum
MDQSHQTYAGTMQNPSYGGGGTMHQQQQPRSYQAVKAATAATAGGSLIVLSGLILTATVISLILATPLLVIFSPVLVPALITVGLLITGFLASGGFGVAAVTVLSWIYRYVTGGHPVGADSLEQARSRLAGKAREVKDRASEFGQQHVTGGQQTS

SEQ ID NO: 3373 - protein, 166 aa, Linum usitatissimum
MASIATAEACDSNAALLASGDLRVLQPIFKIYGQSNAFSGPIVTLKLFEDNVLVREMLETRGEGRVLVVDGAGSMRCALVGGNLGQLAQNMGWAGIVVNGCIRDVDEINACDIGVRALASHPMKSSKRGLGEKHVTVQIGGTLIRDGEWLYADSDGILISKTELSV

SEQ ID NO: 3374 - protein, 206 aa, Linum usitatissimum
MNSKSLAVALLWGALLFGTLALIQAKKSDEKLKEITHKVYFDVEIDGKPAGRITMGLYGKAVPKTAENFRALCTGEKGVGKSGKPLHYKGSSFHRIIPSFMLQGGDFTHGDGRGGESIYGEKFADENFKLKHTGPGLLSMANAGKDTNGSQFFITTVTTSWLDGRHVVFGKVLSGMDVVYKVEAEGKQSGTPKSKVVIVDSGELPL

SEQ ID NO: 3375 - protein, 305 aa, Linum usitatissimum
IPPDQQRLIFAGKQLEDGRTLADYNIQKESTLHLVLRLRGGMQIFLKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGI

SEQ ID NO: 3376 - protein, 323 aa, Linum usitatissimum
MAASTGSTAVAFKSAGFVAASSGERGINQFRHWSPVPASLHFSRAGLRCRSRSSVSSSGVRAQVAAVEPVSSESVKKVESPVVIVTGASRGIGKAIALSLGKAGCKVLVNYARSSKEAEEVSKEIEASGGQAVTFGGDVSKEEDVEAMMKTAIDAFGTVDILINNAGITRDTLLMRMKKQQWQDVIDLNLTGVFLCTQAAAKIMMKKRKGRIINIASVVGLVGNIGQANYSAAKAGVIGFTKSVAKEYSSRNINVNAVAPGFIASDMTAKLGDDIEKKILETIPLGRYGQPEEVAGLVEFLALNPAAGYMTGQVLTIDGGMVM

SEQ ID NO: 3377 - protein, 332 aa, Linum usitatissimum
MAKDPVRVLVTGAAGQIGYALVPMIARGVMLGADQPVILHMLDIPPAAEALNGVKMELVDAAFPLLKGVVATTDVVEACTGVNIAVMVGGFPRKEGMERKDVMSKNVSIYKSQASALEKHAAANCKVLVVANPANTNALILKEFAPSIPEQNITCLTRLDHNRALGQVSERLNVPVSDVKNVIIWGNHSSTQYPDVNHATVKTSSGDKPVRELVKDDVWLNAEFITTVQQRGAAIIKARKLSSALSAASSACDHIRDWVLGTPQGTWVSMGVYSDGSYNVPAGLIYSFPVTCQNGEWKIVQGLAIDEFSRKKLDLTAEELSEEKALAYSCLN

SEQ ID NO: 3378 - protein, 388 aa, Linum usitatissimum
MNVIGEPIDEKGEISTEHFLPIHREAPSFVEQATEQQILVTGIKVVDLLAPYQRGGKIGLFGGAGVGKTVLIMELINNVAKAHGGFSVFAGVGERTREGNDLYREMIESGVIKLGDKQADSKCALVYGQMNEPPGARARVGLTGLTVAEHFRDAEGQDVLLFVDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHILGEDHYGTARGVQKVLQNYKNLQDIIAILGMDELSEDDKLTVARARKIQRFLSQPFHVAEVFTGAPGKYVELKESIQSFQGVLDGKYDDLSEQSFYMVGGIDEVIAKAEKIAKESATS

SEQ ID NO: 3379 - protein, 427 aa, Linum usitatissimum
MGETRDNDYEEELLDYEEEEEKAPDSITAKVNGEAPKKGYVGIHSSGFRDFLLKPELLRAIVDSGFEHPSEVQHECIPQAILGMDVICQAKSGMGKTAVFVLSTLQQIEPTPGQVIALVLCHTRELAYQICHEFERFSTYLPDTKVAVFYGGVNIKTHRDLLKNECPHVVVGTPGRILALARDKELSLKNVRHFILDECDKMLESLDMRRDVQEIFKMTPHDKQVMMFSATLSKEIRPVCKKFMQDPMEIYVDDEAKLTLHGLVQHYIKLTELEKNRKLNDLLDALDFNQVVIFVKSVSRAAELNKLLIECNFPSICIHSGMSQEERLTRYKGFKEGHKRILVATDLVGRGIDIERVNIVINYDMPDSADTYLHRVGRAGRFGTKGLAITFVSSASDSDVLNQVQERFEVDIKELPEQIDTSTYMPS

SEQ ID NO: 3380 - protein, 508 aa, Linum usitatissimum
MGFEKKEHEFLGEIGLSSSNPGCYVGGKWKANGPVITTTNPANNQTIAEVVEGSMEDYEEGLKACSEATKTWMQVPAPKRGEIVRQIGDALRAKLDHLGRLVSLEMGKILAEGVGEVQEIIDMCDFAVGLSRQLNGSIIPSERPNHAMLEMWNPLGIVGVITAFNFPCAVLGWNACLALVCGNCVVWKGAPTTPLVTIAMTKLIAEVLEKNNLPGAIFTSLCGGAEIGQAIAKDTRIPLVSFTGSSKVGQMVQQIVSQRFGKCLLELSGNNAIIVMDDADVQLAARSVLFAAVGTAGQRCTTCRRLLLHESIYKKVLDQLVEAYKQVKIGDPLEKGTLLGPLHTTESRKNFERGIELVKSQGGNILTGGSIIKSDGNFVQPTIVEVAPTVVAVKEELFAPVLYVMKFKTLQEAIDINNSVPQGLSSSIFTQKPETIFKWIGPLGSDCGIVNVNIPTNGAEIGGAFGGEKATGGGREAGSDSWKQYMRRSTCTINYGNELPLAQGINFG

SEQ ID NO: 3381 - protein, 801 aa, Linum usitatissimum
MADSGVVTVYGNAALYEPTTKKSTFSVKVGLAQMLRGGVIMDVVNADQARIAEEAGACAVMALERVPADIRSQGGVARMSDPQLIKEIKQSVTIPVMAKARIGHFVEAQILEALGIDYIDESEVLTLADEDNHINKHNFRIPFVCGCRNLGEALRRIREGAAMIRTKGEAGTGNVIEAVRHVRSVMGDIRVLRNMDDDEVFTFAKKIAAPYDLVMQTKQLGRLPVVQFAAGGVATPADAAMMMQLGCDGVFVGSGVFKSGDPARRARAIVQAVTHYTDPEVLAEVSCGLGEAMVGINLNDPNVERIFRLTEAEPPEYIKFLFDRYSRDGTMTVEDLTRFLVEIQGEHTASHDDALAIFNSLKHLRIFQRRGLHFDAFYRYLLGDLNVANSPSNVVHHNMNAPLSHYFLFTGHNSYLTGNQLSSDSSTKPIINALKKGVRVIELDLWPNNNKDDVEMVNDTFGEILYTPESDEMSEFRSPDYLKKRILISTKPPKEYLETPGSQSSGKERTPSSSFDDKDKDEGHIPDEDEEKTAPQYRHLIAIHAAKMKGGIKNMLKVEANKVRRLSMSEQEFETASKTLATAIVRFTQRNLLRVYPKGSRLDSSNYNPFIGWMHGAQMVAFNMQGYGKHLWTMQGMFSANGGCGYLKKPDFLLELGPDDKVYDPSIPQQVKTTLKGKLYLGEGWLQDFRHTHFDLCSPPDFFVKVGIEGVPGDKAKHITKVIDDEWLPIWDEEFKFELRVPELAILRIEVMDYDVGNHGFGSQTYLPISELQTGIRSVPLYSRDGSRYKHTRLLMQFEFS

SEQ ID NO: 3382 - protein, 136 aa, Solanum tuberosum
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGVFEDTNLCAIHAKRVTIMPKDIQLARRIRGERA

SEQ ID NO: 3383 - protein, 219 aa, Solanum tuberosum
MKSINILSFLLLSSTLSLVAFARSFTSENPIVLPTTCHDNLVLPEVYDQDGNPLRIGERYIIKNPLLGAGAVYLNNIGNLQCPNAVLQHMSIPQFLGKGTPVMFVRKSESDDGDVVRLMTAVYIKFFVKTTKLCVDETVWKVNDEQLVVTGGNVGNENDIFKIKKTDLVIRGMKNVYKLLHCPSHLQCKNIGSNFKNGYPRLVTVDDDKDFIPFVFIKA

SEQ ID NO: 3384 - protein, 222 aa, Solanum tuberosum
MKSINILSFLLLSSTLSLVAFARSFTSENPIVLPTTSHDDDNLVLPEVYDQDGDPLRIGERYIINNPLIGAGAVYLYNIGNLQCPNAVLQHMSIPQFLGKGTPVVFVRKSESDYGDVVRQMTAVYIKFFVKTTKLCVDQTVWKVDDEQLVVTGGKVGNENDIFKIRKIDLVTPGSSKNVYKLLHCPSHLQCKNIGGNFKNGYPRLATVDDDKDFIPFVFIKA

SEQ ID NO: 3385 - protein, 534 aa, Solanum tuberosum
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGNF

SEQ ID NO: 3386 - protein, 123 aa, Solanum tuberosum
MLQHMSIPQFLGEGTPVMFVRKSESDYGDVVRIMTGVYIKFFVKTTKLCVDQTGGKVGNENDIFKIRKTDLVTPGGSKNVYKLLHCPSHLQCKNIGGNFKNGYPRLVTVDDDKEFIPFVFIKA

SEQ ID NO: 3387 - protein, 218 aa, Solanum tuberosum
MKCLFLLCLCLVPIVVFSSTFTSQNLIDLPSESPLPKPVLDTNGKELNPNSSYRIISIGRGALGGDVYLGKSPNSDAPCPDGVFRYNSDVGPSGTPVRFIPLSTNIFEDQLLNIQFNIPTVKLCVSYTIWKVGNLNAYFRTMLLETGGTIGQADNSYFKIVKSSKIGYNLLSCPFTSIICLRCPEDQFCAKVGVVIQNGKRRLALVNENPLDVLFQEV

SEQ ID NO: 3388 - protein, 348 aa, Solanum tuberosum
MVTVLSIDGGGIKGIIPGIILEFLEGQLQKMDNNADARLADYFDVIGGTSTGGLLTAMITTPNENNRPFAAAKDIVPFYFQHGPHIFNSSTGQFFGPKYDGKYLMQVLQEKLGETRVHQALTEVAISSFDIKTNKPVIFTKSNLAKSPELDAKMSDICYSTAAAPTYFPPHYFATNTSNGDKYEFNLVDGAVATVADPALLSVSVATRRAEEDPAFASIRSLNYKQLLLLSLGTGTNSEFDKTHTAQETAKWGALQWMLVIQQMTEAASSYMTDYYLSTVFQDLHSQNNYLRVQENALTGTTTKADDASEANMELLVQVGENLLKKPVSKDNPETYEEALKRINRGYG

SEQ ID NO: 3389 - protein, 377 aa, Solanum tuberosum
MAEGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDVKEKLSYIALDFEQELETSKTSSSVEKSYELPDGQVITIGAERFRCPEVLFQPSLIGMEAAGIHETTYNSIMKCDVDIRKDLYGNIVLSGGTTMFPGIADRMSKELTALAPSSMKIKVVAPPERKYSVWIGGSILASLSTFQQMWIAKAEYDESGPSIVHRKCF

SEQ ID NO: 3390 - protein, 858 aa, Solanum tuberosum
MGGRELFGGHDDSKKVKGTVVMMKKNALDFTDLAGSVTDKIFEAFGQKVSFQLISSVQGDPRNGLQGKHSNPAYLENSLFTLTPLTAGSETAFGVTFDWNEEFGVPGAFIIKNTHINEFFLKSLTLEDVPNHGKVHFVCNSWVYPSFRYKSDRIFFANQPYLPSKTPELLRKYRENELLTLRGDGTGKREAWDRIYDYDIYNDLGNPDQGQENVRTTLGGSAEYPYPRRGRTGRPPTRTDPKSESRIPLILSLDIYVPRDERFGHLKMSDFLTYALKSIVQFILPELHALFDGTPNEFDSFEDVLRLYEGGIKLPQGPLFKALTAAIPLEMIKELLRTDGEGILRFPTPLVIKDSKTAWRTDEEFAREMLAGVNPIIISRLQEFPPKSKLDPEAYGNQNSTITAEHIEDKLDGLTVDEAMNNNKLFILNHHDLLIPYLRRINTTITKTYASRTLLFLQDNGSLKPLAIELSLPHPDGDQFGVTSKVYTPSDQGVESSIWQLAKAYVAVNDAGVHQLISHWLNTHAVIEPFVIATNRQLSVLHPIHKLLYPHFRDTMNINASARQILINAGGVLESTVFQSKFALEMSAVVYKDWVFPDQALPADLVKRGVAVEDSSSPHGVRLLIEDYPYAVDGLEIWSAIKSWVTDYCSFYYGSDEEILKDNELQAWWKELREVGHGDKKNEPWWPEMETPQELIDSCTTIIWIASALHAAVNFGQYPYAGYLPNRPTVSRRFMPEPGTPEYEELKKNPDKAFLKTITAQLQTLLGVSLVEILSRHTTDEIYLGQRESPEWTKDKEPLAAFDKFGKKLTDIEKQIIQRNGDNILTNRSGPINAPYTLLFPTSEGGLTGKGIPNSVSI

SEQ ID NO: 3391 - protein, 142 aa, Solanum tuberosum; identical to SEQ ID NO: 572

SEQ ID NO: 3392 - protein, 103 aa, Solanum tuberosum; identical to SEQ ID NO: 1753

SEQ ID NO: 3393 - protein, 154 aa, Solanum tuberosum
MDVHKEVNFVAYLLIVLGLLVLVSAMEHVDAKACTLECGNLGFGICPRSEGSPENRICTNCCAGYKGCNYYSANGAFICEGQSDPKKPKACPLNCDPHIAYSKCPRSEGKSLIYPTGCTTCCTGYKGCYYFGKNGKFVCEGESDEPKANMYPAM

SEQ ID NO: 3394 - protein, 232 aa, Solanum tuberosum
MQVLQEKLGETRVHQALTEVAISSFDIKTNKPVIFTKSNLANAPELDAKMYDICYSTAAAPIYFPPHYFTTHTSNGDIYEFNLVDGGVATVGDPALLSLSVATKLAQVDPKFASIKSLDYKQMLLLSLGTGTNSEFDKTYTAEEAAKWGPLRWMLAIQQMTNAASSYMTDYYISTVFQARHSQNNYLRVQENALTGTTTEMDDASEANMDLLVQVGETLLKKPVSKDSPENL

SEQ ID NO: 3395 - protein, 314 aa, Solanum tuberosum
MASLTVPAEVPSVAEDCEQLRSAFKGWGTNEKLIISILAHRNAAQRKLIRQTYAETFGEDLLKELDRELTHDFEKLVLIWTLDPSERDAYLAKEATKRWTKSNFVLVEIACTRSPKELVLAREAYHARNKKSLEEDVAYHTTGDHRKLLVPLVSSYRYGGDEVDLRLAKAESKVLHEKISDKAYSDDEVIRILATRSKAQLNATLNHYKDEYGEDILKQLEDEDEFVALLRATIKGLVYPEHYFVEVLRDAINRRGTEEDHLSRVIATRAEVDLKTIANEYQKRDSIPLGRAIAKDTGGDYENMLVALLGQEEE

SEQ ID NO: 3396 - protein, 338 aa, Solanum tuberosum
MANGKIKIGINGFGRIGRLVARVALQRDDVELVAVNDPFISTDYMTYMFKYDSVHGQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPSLNGKLTGMAFRVPTADVSVVDLTVRLEKEASYEDIKAAIKEESEGKLKGILGYTEDDVVSTDFVGDSRSSIFDAKAGIALSKNFVKLVSWYDNEWGYSSRVIDLICHMAKA

SEQ ID NO: 3397 - protein, 414 aa, Solanum tuberosum
MNDTHPTLCIPELMRILIDLKGLNWNEAWNITQRTVAYTNHTVLPEALEKWSYELMQKLLPRHVEIIEAIDEELVHEIVLKYGSMDLNKLEEKLTTMRILENFDLPSSVAELFIKPEISVDDDTETVEVHDKVEASDKVVTNDEDDTGKKTSVKIEAAAEKDIDKKTPVSPEPAVIPPKKVRMANLCVVGGHAVNGVAEIHSEIVKEEVFNDFYELWPEKFQNKTNGVTPRRWIRFCNPPLSAIITKWTGTEDWVLKTEKLAELQKFADNEDLQNEWREAKRSNKIKVVSFLKEKTGYSVVPDAMFDIQVKRIHEYKRQLLNIFGIVYRYKKMKEMTAAERKTNFVPRVCIFGGKAFATYVQAKRIVKFITDVGATINHDPEIGDLLKVVFVPDYNVSVAELLIPASDLSEHIR

SEQ ID NO: 3398 - protein, 652 aa, Solanum tuberosum
MAGKGEGPAIGIDLGTTYSCVGVWQHDRVEIIANDQGNRTTPSYVAFTDTERLIGDAAKNQVAMNPVNTVFDAKRLIGRRFSDPSVQSDMKLWPFKVIPGPADKPMIVVTYKGEEKQFSAEEISSMVLTKMKEIAEAYLGTTIKNAVVTVPAYFNDSQRQATKDAGVISGLNVMRIINEPTAAAIAYGLDKKSTSTGEKNVLIFDLGGGTFDVSLLTIEEGIFEVKATAGDTHLGGEDFDNRMVNHFVQEFKRKHKKDISGNPRALRRLRTACERAKRTLSSTAQTTIEIDSLYEGIDFYTTITRARFEEKNMDLFRKCMEPVEKCLRDAKMDKSGVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERARTKDNNLLGKFELSGIPPAPRGVPQINVCFDIDANGILNVSAEDKTTGQKNKITITNDKGRLSKEEIERMVQEAEKYKSEDEELKKKVEAKNGLENYAYNMRNTIKDDKVSSQLPAADKKKIEDAIDEAIKWLDSNQLAEADEFEDKMKELESVCNPIIAKMYQGGAGGATMDEDDGPSVGGGAGSGSGAGPKIEEVD

SEQ ID NO: 3399 - protein, 56 aa, Solanum tuberosum
MDDASEANMDLLVQVGETLLKKPVSKDSPETYEEALKRFAKLLSDRKKLRANKASY

SEQ ID NO: 3400 - protein, 181 aa, Solanum tuberosum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 3401 - protein, 447 aa, Solanum tuberosum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQLNEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAKGAASFTAQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVDKKDPSGAKVTKAAQKKK

SEQ ID NO: 3402 - protein, 78 aa, Solanum tuberosum; identical to SEQ ID NO: 595

SEQ ID NO: 3403 - protein, 150 aa, Solanum tuberosum
MSKRKTREPKEETVTLGPATREGELVFGVAHIFASFNDTFIHVTDLSGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 3404 - protein, 203 aa, Solanum tuberosum
MKQAYYLSMEFLQGRALLNAIGNLELTGAFAEALKNLGHNLENVASQEPDAALGNGGLGRLASCFLDSLATLNYPAWGYGLRYKYGLFKQRITKDGQEEVAEDWLEIGSPWEVVRNDVSYPIKFYGKVSTGSDGKRYWIGGEDIKAVAYDVPIPGYKTRTTISLRLWSTQVPSADFDLSAFNAGEHTKACEAQANAEKVYLIY

SEQ ID NO: 3405 - protein, 142 aa, Solanum tuberosum; identical to SEQ ID NO: 621

SEQ ID NO: 3406 - protein, 205 aa, Solanum tuberosum; identical to SEQ ID NO: 566

SEQ ID NO: 3407 - protein, 490 aa, Solanum tuberosum
MTISPRYDQYKDAWDTSVAVEVKVGDSIEIVRFFHCYKRGVDRVFVDHPMFLEKVWGKTGSKIYGPKAGLDYLDNELRFSLLCQAALEAPKVLNLNSSNYFSGPYGEDVLFIANDWHTALIPCYLKSMYQSRGIYLNAKVAFCIHNIAYQGRFSFSDFPLLNLPDEFRGSFDFIDGYEKPVKGRKINWMKAGILESHRVVTVSPYYAQELVSAVDKGVELDSVLRKTCITGIVNGMDTQEWNPATDKYTDVKYDITTVMDAKPLLKEALQAAVGLPVDKKIPLIGFIGRLEEQKGSDILVAAIHKFIGLDVQIVVLGTGKKEFEQEIEQLEVLYPNKAKGVAKFNVPLAHMITAGADFMLVPSRFEPCGLIQLHAMRYGTVPICASTGGLVDTVKEGYTGFHMGAFNVECDVVDPADVLKIVTTVARALAVYGTLAFAEMIKNCMSEELSWKEPAKKWETLLLGLGASGSEPGVEGEEIAPLAKENVATP

SEQ ID NO: 3408 - protein, 492 aa, Solanum tuberosum
MDPSKYRPSSAYDTPFLTTNAGGPVYNNVSSLTVGPRGPVLLEDYYLIEKLATFDREKIPERVVHARGASAKGFFEVTHDISHLSCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKCMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPACVLNGRRTNCVIPKENNFKQAGERYRSWESDRQDRYITKWVESLSDPRVTHEIRSIWISYLSQADKSCGQKVASRLTVKPTM

SEQ ID NO: 3409 - protein, 765 aa, Solanum tuberosum
MASHVVGYPRMGPKRELKFALESFWDGKSSAEDLKKVSADLRSSIWKQMSDAGIKYIPSNTFSYYDQVLDTTTMLGAVPSRYNWTGGEIEFGTYFSMARGNASVPAMEMTKWFDTNYHFIVPELGPDVNFSYASHKAVNEYKEAKAQGVDTVPVLVGPVSYLLLSKPAKGVDKSFPLLSLLDKILPIYKEVIAELKAAGASWIQLDEPTLVLDLESHKLEAFTKAYADLESSLSGLNVLVETYFADVPAGAFKTLTALKGVTAFGFDLVRGTQTLELIKSSFPSGKYLFAGVVDGRNIWASDLAASLALLQSLEGVVGKDKLVTSTSCSLLHTAVDLINETKLDDEIKSWLAFAAQKVVEVNALAKALSGAKDEAFFSANAAAQASRKSSPRVTNEAVRKASAALQGSDHRRATNVSARLDAQQKKLNLPILPTTTIGSFPQTVELRRVRREYKAKKISEEEYVKAITEEIKKVVDLQEELDIDVLVHGEPERNDMVEYFGEQLSGFAFTANGWVQSYGSRCVKPPIIYGDVSRPKAMTVFWSSKAQEMTKRPMKGMLTGPVTILNWSFVRNDQPRFETCYQIALAIKDEVEDLEKAGITVIQIDEAALREGLPLRKAEHTSYLNWAVHSFRITNVGIQDTTQIHTHMCYSNFNDIIHSIIDMDADVITIENSRSDEKLLSVFREGVKYGAGIGPGVYDIHSPRIPSTEEIADRVNKMLAVLETNILWVNPDCGLKTRKYTEVKPALQNMVSAAKTIRTQLASAK

SEQ ID NO: 3410 - protein, 140 aa, Solanum tuberosum
MSKRGRGGSAGNKFRMSLGLPVAATVNCADNTGAKNLYIISVKGIKGRLNRLPSACVGDMVMATVKKGKPELRKKVMPAVIVRQRKPWRRKDGVFMYFEDNAGVIVNPKGEMKGSAITGPIGKECADLWPRIASAANAIV

SEQ ID NO: 3411 - protein, 227 aa, Solanum tuberosum
MKSINILSFLLLSSTLSLVAFAQSFTSENPIVLPTTSHDDDNLVLPEVYDDEGHPLRIGEEYIINNPLLGAGAVYLDNIGNLTCPNAVLQHISTFNLSGDGTPVKFVRKSESDDGDVVRVMTVVYIKFFPNIPNLLCVNENVWKVNDEELVVTGGNVGNENDIFKIMKTDLVTPEGSKYVYKLLHCPAHLECKNIGVNFKDGYPRLTTVDDDKNFAPFVFSKAKNAN

SEQ ID NO: 3412 - protein, 381 aa, Solanum tuberosum
MAMSRVASTAARAITSPSSLVFTRELQASPGPKKIVGVFYKANEYAEMNPNFLGCAENALGIREWLESKGHQYIVTPDKEGPDCELEKHIPDLHVLISTPFHPAYVTAERIKKAKNLQLLLTAGIGSDHVDLKAAAAAGLTVAEVTGSNTVSVAEDELMRILILVRNFLPGHHQVINGEWNVAAIAHRAYDLEGKTVGTVGAGRIGRLLLQRLKPFNCNLLYHDRLKMDSELENQIGAKFEEDLDKMLSKCDIVVINTPLTEKTKGMFDKERIAKLKKGVLIVNNARGAIMETQAVVDACNSGHIAGYSGDVWYPQPAPKDHPWRYMPNQAMTPHISGTTIDAQLRYAAGTKDMLDRYFKGEDFPAENYIVKDGELAPQYR

SEQ ID NO: 3413 - protein, 444 aa, Solanum tuberosum
MATIKSIKARQIFDSRGNPTVEVDVHVSNGVFARAAVPSGASTGIYEALELRDGGSDYLGKGVSKAVNNVNSIIGPALIGKDPTDQTGLDNFMVHELDGTQNEWGWCKEKLGANAILAVSLAVCKAGAAVRNVPLYKHIADLAGNKKLVLPVPAFNVINGGSHAGNKLAMQEFMILPVGAANFKEAMKMGCEVYHHLKSVIKKKYGQDATNVGDEGGFAPNIQENKEGLELLKTAIEKAGYTGKVVIGMDVAASEFYGKDKSYDLNFKEESNDGSQKISGDQLKDLYKSFVSEYPIVSIEDPFDQDDWETYAKLTTEIGEQVQIVGDDLLVTNPKRVAKAIAEKTCNALLLKVNQIGSVTESIEAVKMSKKAGWGVMTSHRSGETEDTFIADLAVGLSTGQIKTGAPCRSERLAKYNQLLRIEEELGSEAVYAGASFRKPVEPY

SEQ ID NO: 3414 - protein, 579 aa, Solanum tuberosum
MESALKDLSTPTGGVEDVYGEDCATEDQCITPWTIAVSSGYNLLRDPRYNKGLAFTERERDAHYLRGLLPPVISSQELQEKKLMQSIRQYDVPLHKYVAMMELEERNERLFYKLLIDNVEELLPIVYTPTVGEACQKYGSIFKRPQGLYISLNEKGRILEVLKNWPEKSIQVIVVTDGERILGLGDLGCQGMGIPVGKLALYTALGGVRPSACLPITIDVGTNNEKLLNDEFYIGLKQRRATGQEYYDFLHEFMSAVKQNYGEKILVQFEDFANHNAFELLAKYRTSHLVFNDDIQGTASVVLAGLIASLKLLGGALCDHTFLFLGAGEAGTGIAELIALEISNKTKIPVEETRKKIWLVDSKGLIVSGRKETLQAFKKPWAHEHEPVNNLLDAVKAVKPTVLIGTSGTGRTFTKEVVEAMACMNKRPLIMALSNPTSQAECTAEEAYTWSEGRVVFASGSPFPSFEYDGKLNIPGQANNCYIFPGFGFGLVMSGTIRVHDDMLLAASEALAAQVTEEHYAKGMIYPPFADIRKISAHIAASVAAKAYELGVATRLPQPADLVKYAESCMYTPNYRSYR

SEQ ID NO: 3415 - protein, 761 aa, Solanum tuberosum
MGLMSEALTQILIPLAAFIGIGFALLQWFLVSKVRVSSGSNLVSEYNDKLIEEDEQEEGIDSDDVVAKCADIQKAISEGATSFLFTEYKYLGIFMVVFGAIIFLFLGSVKSFSTESEPCTFNKEKICKPALANAFFTTIAFFLGGLTSALSGFLGMKIATYANARTTLEARKSIGKAFIIAFRSGAVMGFLLAANGLLVLYISINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGSSHDYSAMSYPLIISSMGIVVCLITTLFATDMFEIKNVTEIEPSLKRQLLISTVLMTVGIAFVSFFALPSEFTIFDFGSEKVVKNWHLFFCVSIGLWAGLVIGYTTEYYTSSAYSPVQEVADSCKTGAATNVIFGLALGYKSVIIPIFAIAASIYVSFSLAAMYGIAVAALGMLSTIATGLAIDAYGPISDNAGGIAEMAGMSHSIRERTDALDAAGNTTAAIGKGFAIGSAALVSLALFGAYVSRAGIKTVDVLSPKVFIGLLVGAMLPYWFSAMTMKSVGSAALKMVEEVRRQFNSIPGLMEGTAKPDYATCVKISTDASLKEMIPPGALVMLTPLIAGTFFGVETLAGVLAGSLVSGVQVAISASNTGGAWDNAKKYIEAGATEHARSLGPKGSDAHKAAVIGDTVGDPLKDTSGPSLNILIKLMAVESLVFAPFFATHGGLLFKLL

SEQ ID NO: 3416 - protein, 92 aa, Gossypium barbadense
MARSLKKNPFVANHLLKKIERLNTKAEKEIIITWSRASTIIPTMIGHTIAIHNGKEHLPIYITDRMVGHKLGEFAPTINFRGHAKNDNKSRR

SEQ ID NO: 3417 - protein, 92 aa, Bifidobacterium adolescentis
  source: /note="strain ATCC 15703 / DSM 20083 / NCTC 11814 / E194a"
MTRSIKKGPFVDAHLQKKVDEQNEKGTHNVIKTWSRRSMITPDFIGHTFAVHDGRKHVPVFVTESMVGHKLGEFAPTKTFKGHVKDDKKARR

SEQ ID NO: 3418 - protein, 72 aa, Bifidobacterium adolescentis
  source: /note="strain ATCC 15703 / DSM 20083 / NCTC 11814 / E194a"
MAKDGVIEVEGQVVEALPNAMFRVELENKHIVLATISGKMRKNYIRILPQDRVVLEMSPYDLNRGRITYRYK

SEQ ID NO: 3419 - protein, 62 aa, Oryza sativa
  source: /note="subsp. indica"
MSDKCGNCDCADKSQCVKKGTSYGVVIVEAEKSHFEEVAAGEENGGCKCGTSCSCTDCKCGK

SEQ ID NO: 3420 - protein, 244 aa, Oryza sativa
  source: /note="subsp. indica"
MDRYGEKQQQQQMFASYVDASLLAASGEVQGERPRARRRRRRGARCVGGGGGGGEVDGGDPKKRRLSDEQVEMLELSFREERKLETGRKVHLASELGLDPKQVAVWFQNRRARHKSKLLEEEFSKLKHAHDAAILHKCHLENEVLRLKERLVVAEEEVRRLRSAAGSHTASGEGGDIMGLGGSGACVAGSPSSSFSTGTCQPPSFGGGGGGGDHLGDDDLVYVPEYGGYADNSVVEWFSLYGLI

SEQ ID NO: 3421 - protein, 119 aa, Phaseolus vulgaris
MTRIKRGYIARKRRTKIRLFVSSFRGAHSRLTRTITQQKMKALVSAHRDRDRKKRDFRGLWISRINAVIRGNPKVSYIYSNLIHSLYTRQLLLNRKIVAQIAILKENCLFMIANNIIKT

SEQ ID NO: 3422 - protein, 92 aa, Populus trichocarpa
MTRSLKKNPFVANHLLRKINKLNTKAEKNLIVTWSRASTIIPTMIGHTIAIHNGKEHLPIYITDRMVGHKLGEFAPTLNFRGHAKNDNKSRR

SEQ ID NO: 3423 - protein, 567 aa, Sus scrofa
MHGRLKVKTSEEQAEAKRLEREQKLKLYQTATQTVFQKRQAGELDESVLELTSQILGANPDFATLWNCRREVLQRLEVQKSPEELAALVKAELGFLESCLRVNPKSYGTWHHRCWLLGRLPEPNWARELELCARFLEVDERNFHCWDYRRFVASQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGPSTETLLLMVNESPLSVEWRTPDGRNRPSHVWLCDLPAASLNDHLPQHTFRVIWTAGNAQKECVLLKGRQEGWCRDSATDEQLFRCELSVEKSTVLQSELESCKELQELEPENKWCLLTIILLMRALDPLLYEKETLQYFQTLKAVDPMRAAYLDDLRSKFLLENSVLKMEYADVRVLHLGHKDLTVLCHLEQLLLVTHLDLSHNRLRALPPALAALRCLEVLQANDNAIESLDGVTNLPRLQELSLCNNRLQQPAVLQPLASCPRLVLLNLQDNPLCQAVGISEHLAELLPSVSSILT

SEQ ID NO: 3424 - protein, 108 aa, Sus scrofa
MTAHILLLWLFASSILGDPDSAGRLTRHQVSLKSGRLCSLGTCQTHRLPEIIYWLRSASTKELSGKAGRKPQDPYSYGRRRRRRRRRREARLLRRLQDPSLRRAQLAG

SEQ ID NO: 3425 - protein, 185 aa, Lactobacillus reuteri
  source: /note="strain DSM 20016"
MDLKVFDGQDKSELSMIEVAHAILAHHGKAMAFVDLTNEVQQYLGKSDEEIRERLAQFYTDLNVDGSFISLGDNTWGLRAWYPFESIDEATVGENEEDEEDDRPKKKRRKVNAFLADTDDDDDVIDYDNDDPEDEDLDTDDDADSEDDYDDDTDDFSDDDDDLDDGIEGQLSELHDEEDEDEDDE

SEQ ID NO: 3426 - protein, 158 aa, Lactobacillus reuteri
  source: /note="strain DSM 20016"
MAKVESFTLDHTKVKAPYVRLITVEEGPKGDKISNYDLRLVQPNENAIPTAGLHTIEHLLAGLLRDRLGGVIDCSPFGCRTGFHLITWGEHSTTEVAKALKSSLEEIAYKTKWEDVQGTTIESCGNYRDHSLFSAKEWSKKILDEGISDKPFERHVVD

SEQ ID NO: 3427 - protein, 344 aa, Bubalus bubalis
MARPRHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGLVCGLDGKTYRNECALLKARCKEQPELQVQYQGKCKKTCRDVFCPGSSTCVVDQTNNAYCVTCNRICPEPTSSEQYLCGNDGVTYPSACHLRKATCLLGRSIGLAYEGKCIKAKSCDDIQCTGGKKCLWDFKVGRGRCSLCGELCPESKSEEPVCASDNATYASECAMKEAACSSGVLLEVKHSGSCNSISEDTEDEEEDEDQDYSFPISSILEW

SEQ ID NO: 3428 - protein, 582 aa, Bos taurus
MSSSLGKEKDSKEKDPKAPSAKEREKEAKASGGFGKESKEKEPKTKGKDAKDGKKDSSAAQPGVAFSVDNTIKRPNPAPGTRKKSSNAEVIKELNKCREENSMRLDLSKRSIHILPSSIKELTQLTELYLYSNKLQSLPAEVGCLVNLMTLALSENSLTSLPDSLDNLKKLRMLDLRHNKLREIPSVVYRLDSLTTLYLRFNRITTVEKDIKNLSKLSMLSIRENKIKQLPAEIGELCNLITLDVAHNQLEHLPKEIGNCTQITNLDLQHNELLDLPDTIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 3429 - protein, 131 aa, Bos taurus
MPPKGKSGSGKGGKGKAASGSESSEKKAQGPKGGGNAVKVRHILCEKHGKILEAMEKLKSGMKFNEVAAQYSEDKARQGGDLGWMTRGSMVGPFQEAAFALPISVLDKPVFTDPPVKTKFGYHIIMVEGRK

SEQ ID NO: 3430 - protein, 69 aa, Saccharomyces cerevisiae
  source: /note="strain YJM789"
MTVKICDCEGECCKDSCHCGSTCLPSCSGGEKCKCDHSTGSPQCKSCGEKCKCETTCTCEKSKCNCEKC

SEQ ID NO: 3431 - protein, 271 aa, Saccharomyces cerevisiae
  source: /note="strain YJM789"
MGLAATRTKQRFGLDPRNTAWSNDTSRFGHQFLEKFGWKPGMGLGLYPMNSNTSHIKVSIKDDNVGLGAKLKRKDKKDEFDNGECAGLDVFQRILGRLNGKESKISEELDTQRKQKIIDGKWGIHFVKGEVLASTWDPKTHKLRNYSNAKKRKREGDDSEDEDDDDKEDKDSDKKKHKKHKKHKKDKKKDKKDKKEHKKHKKEEKRLKKEKRAEKTKETKKTSKLKSSESASNIPDAVNTRLSVRSKWIKQKRAALMDSKALNEIFMITND

SEQ ID NO: 3432 - protein, 93 aa, Ipomoea purpurea
MARSLKKNPFVANHLLKKIDKLNRKAEKEIIRTWSRGSTIIPTMIGHTIAIHNGKEHLPIYITDHMVGHKLGEFASTFNFRGHTKSDNKSRRR

SEQ ID NO: 3433 - protein, 166 aa, Bos taurus
MSAPPPLQIREANAHLAAVHRRAAELEARLEAAECMVRAQAERLARHDQQLSAALDELGRAKDREIAALREQLLTSEAAVQSLQAAVRQRDKLIGQLQPRAELLQDLCRRRPPLAGLLATLAEAERLGPLPASDLLPGGPSSPLANSTGEEEGSDQLEPAVFGTTV

SEQ ID NO: 3434 - protein, 117 aa, Carica papaya
MTRIKRGYIARRRRTKIRLFASSFRGAHSRLTRTITQQRIRALVSAHRDRGRKKRDFRRLWITRINAVIRGDGVSYSYNRFIHNLYKKQLLLNRKILAQIAISNRSCLYTISNEIRK

SEQ ID NO: 3435 - protein, 37 aa, Carica papaya
MKIRASVRKICEKCRLIRRRGRIIVICSNPRHKQRQG

SEQ ID NO: 3436 - protein, 131 aa, Lactobacillus reuteri
  source: /note="strain JCM 1112"
MKKTGIINSEVSAVVANMGHMDWLSIGDAGMPVPFGTKKIDLAVDKELPSFMDVLNNVLKEMKVQKIYLAEEIKDQNPAQLENIKKALPDVEVAFMPHSELKKSLTKTHAFIRTGEMTPYSNIILESGVTF

SEQ ID NO: 3437 - protein, 73 aa, Lactobacillus reuteri
  source: /note="strain JCM 1112"
MRMSFYQFLMTQRNPNSADEVQQFANNAFFDTTFPKHSEDFDEISHYLEENADYLPSMTIFDEAWQRYIDAMN

SEQ ID NO: 3438 - protein, 106 aa, Lactobacillus casei
  source: /note="strain BL23"
MANNEHVTPGEDDQQITLIDEKGNEELYQVLFTFDSEDYGKSYVLLYPASESDDQEVEIQAFSFTPDENGDASSGDLFPIEDDAEWDMVEEVLNTFLADDDSNLKD

SEQ ID NO: 3439 - protein, 333 aa, Salmo salar
MNDTLALLQKFNAHPDSRCWYVAWNPKGTLLASCGGDRTIRIWGREGDSWECKTVLQDGHQRTVRKVAWSPCGNYLASASFDATTCIWKKKNDDFECLTVLEGHENEVKCVAWAPSGNLLATCSRDKSVWIWEVDEENEYECVSVVNSHTQDVKHVVWHPTQELLASCSYDNNVCVYKEEDDDWECRATLEGHTSTVWGLTFDPSGQRLASCSDDCTVKIWKECQPEGGQEGTDAAWKCVCTLSGFHGRTVYDIAWCPLTGALATACGDDGVRVFKEDETADPDQPAFSLSAHVPKAHTQDVNCIAWHPKEAGLLVSCSDNGEIAVWNYQSGV

SEQ ID NO: 3440 - protein, 330 aa, Salmo salar
MKDTLALLQKFNAHPDSRCWYVAWNPKGTLLASCGGDRAIRIWGREGDSWECKTVLQDGHQRAVRKVAWSPCGNYLASASFDATTCIWKKKNDDFECLTVLEGHENEVKCVAWAPSGNQLATCSRDKSVWIWEVDEEDEYECVSVVNSHTQDVKHVVWHPTQELLASCSYDNNVCVYKEEDDDWECRATLEGHTSTVWGLTFDPSGQRLASCSDDRTVKIWKECQPGGGQDTAWKCVCTLSGFHGRTVYDIAWCPLTGALATACGDDGVRVFKEDETADPDQPVFSLSAHVPKAHSQDVNCIAWHPKEAGLLVSCSDNGEIAVWNYQSEV

SEQ ID NO: 3441 - protein, 61 aa, Bifidobacterium longum
  source: /note="subsp. infantis"
  source: /note="strain ATCC 15697 / DSM 20088 / JCM 1222 / NCTC 11817 / S12"
MAKNLKITLHHGIVNRTPAQRATVKTLGLNKIGKTVVREDTPANRGLVNAVRHLVTVEEVD

SEQ ID NO: 3442 - protein, 92 aa, Bifidobacterium longum
  source: /note="subsp. infantis"
  source: /note="strain ATCC 15697 / DSM 20088 / JCM 1222 / NCTC 11817 / S12"
MTRSIKKGPFVDAHLQKKVDEQNEKGTKNVIKTWSRRSMITPDFIGHTFAVHDGRKHVPVFVTEAMVGHKLGEFAPTKTFKGHVKDDKKARR

SEQ ID NO: 3443 - protein, 92 aa, Bifidobacterium animalis
  source: /note="subsp. lactis"
  source: /note="strain AD011"
MTRSIKKGPFVDAHLQKKVDEQNAKGTHNVIKTWSRRSMITPDFIGHTFAVHDGRKHVPVFVTESMVGHKLGEFAPTRTFKGHVKDDKKSRR

SEQ ID NO: 3444 - protein, 563 aa, Bos taurus; identical to SEQ ID NO: 751

SEQ ID NO: 3445 - protein, 360 aa, Saccharomyces cerevisiae; identical to SEQ ID NO: 734
  source: /note="strain FostersB"

SEQ ID NO: 3446 - protein, 446 aa, Bos taurus; identical to SEQ ID NO: 750

SEQ ID NO: 3447 - protein, 559 aa, Bos taurus; identical to SEQ ID NO: 761

SEQ ID NO: 3448 - protein, 441 aa, Sus scrofa; identical to SEQ ID NO: 731

SEQ ID NO: 3449 - protein, 591 aa, Meleagris gallopavo; identical to SEQ ID NO: 781

SEQ ID NO: 3450 - protein, 616 aa, Bos taurus; identical to SEQ ID NO: 776

SEQ ID NO: 3451 - protein, 264 aa, Sus scrofa; identical to SEQ ID NO: 746

SEQ ID NO: 3452 - protein, 132 aa, Oryza sativa
  source: /note="subsp. japonica"
MVVLQPDPFLSELTSMYERSTEKGSVWVTMKRSSMKCQARLKKMAAKGEAVEYRCLVRATDGKKNICTALSAKEYLKFQASYATVLKAHMHALKKRERKDKKKAAEVEKIPEKAPKKQKKAPSSKKSAGSKS

SEQ ID NO: 3453 - protein, 172 aa, Gallus gallus
MSSNECFKCGRTGHWARECPTGIGRGRGMRSRGRAGFQFMSSSLPDICYRCGESGHLAKDCDLQEDKACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 3454 - protein, 344 aa, Equus caballus
MVRPRHQPGGLCLLLLLLCQFMEDRSAQAGNCWLRQAKNGRCQVLYKTELSKEECCSTGRLSTSWTEEDVNDNTLFKWMIFNGGAPNCIPCKETCDNVDCGPGKKCRMNKKNKPRCVCAPDCSNITWKGPVCGLDGKTYRNECALLKARCKEQPELEVQYQGKCKKTCRDVNCPGSSTCVVDQTNNAYCVTCNRICPEPTSSEQYLCGNDGVTYSSACHLRKATCLLGRSIGLAYEGKCIKAKSCEDIQCTGGKKCLWDFKVGRGRCSLCDELCPDSKSEEPVCASDNATYASECAMKEAACSSGVLLEVKHSGSCNSISEDTEEEEEDEDQDYSFPISSILEW

SEQ ID NO: 3455 - protein, 147 aa, Saccharomyces cerevisiae
  source: /note="strain ATCC 204508 / S288c"
MGMLELVGEYWEQLKITVVPVVAAAEDDDNEQHEEKAAEGEEKEEENGDEDEDEDEDEDDDDDDDEDEEEEEEVTDQLEDLREHFKNTEEGKALVHHYEECAERVKIQQQQPGYADLEHKEDCVEEFFHLQHYLDTATAPRLFDKLK

SEQ ID NO: 3456 - protein, 90 aa, Bos taurus [sequence omitted]

SEQ ID NO: 3457 - protein, 90 aa, Gallus gallus
MPKRKAEGDTKGDKAKVKDEPQRRSARLSAKPAPPKPEPKPKKAAPKKSEKVPKGKKGKADAGKEGNNPAENGDAKTDQAQKAEGAGDAK

SEQ ID NO: 3458 - protein, 169 aa, Bos taurus
AAQKRPSQRSKYLASASTMDHARHGFLPRHRDTGILDSLGRFFGSDRGAPKRGSGKDGHHAARTTHYGSLPQKAQGHRPQDENPVVHFFKNIVTPRTPPPSQGKGRGLSLSRFSWGAEGQKPGFGYGGRASDYKSAHKGLKGHDAQGTLSKIFKLGGRDSRSGSPMARR

SEQ ID NO: 3459 - protein, 50 aa, Sus scrofa
MARYRCCRSHSRSRCRPRRRRCRRRRRRCCPRRRRAVCCRRYTVIRCRRC

SEQ ID NO: 3460 - protein, 155 aa, Bos taurus
MYKIQLLSCIALTLALVANGAPTSSSTGNTMKEVKSLLLDLQLLLEKVKNPENLKLSRMHTFDFYVPKVNATELKHLKCLLEELKLLEEVLNLAPSKNLNPREIKDSMDNIKRIVLELQGSETRFTCEYDDATVNAVEFLNKWITFCQSIYSTMT

SEQ ID NO: 3461 - protein, 176 aa, Saccharomyces cerevisiae
  source: /note="strain ATCC 204508 / S288c"
MTAQQAPKWYPSEDVAAPKKTRKAVRPQKLRASLVPGTVLILLAGRFRGKRVVYLKHLEDNTLLVTGPFKVNGVPLRRVNARYVIATSTKVSVEGVNVEKFNVEYFAKEKLTKKEKKEANLFPEQQTKEIKTERVEDQKVVDKALLAEIKKTPLLKQYLSASFSLKNGDKPHLLKF

SEQ ID NO: 3462 - protein, 87 aa, Bos taurus
MSQAEFDKAAEEVKHLKTKPADEEMLFIYSHYKQATVGDINTERPGMLDFKGKAKWDAWNELKGTSKEDAMKAYIDKVEELKKKYGI

SEQ ID NO: 3463 - protein, 116 aa, Triticum aestivum
MSYISGARSLPDEQVRIASTKMDGIGPKKAIQLRYRLGISGNIKMNELTKYQIDQIEQMIAQDHVVHWELKRGERADIERLISISRYRGIRHQDGSPLRGQRTHTNARTARKQIRK

SEQ ID NO: 3464 - protein, 102 aa, Zea mays
MQMVQLQIRVKMIWLLFMNHNHNHNHNQNHNHSHNLNPKKKHHRRGQRSAHRMYGSISPRRKLKWRSMERNTFRYGDIATFLIARLSIGLRVIMEQADFEIT

SEQ ID NO: 3465 - protein, 85 aa, Saccharomyces cerevisiae
  source: /note="strain ATCC 204508 / S288c"
MAEKQRQLKLQKIYKQKYIGLGDESTTREQWQRNVRNDTLNTLQGHSASLEYVSLSRGDLSIRDTRIHLLKSMSPGYKAYLREER

SEQ ID NO: 3466 - protein, 108 aa, Saccharomyces cerevisiae
  source: /note="strain ATCC 204508 / S288c"
MPPKQQLSKAAKAAAALAGGKKSKKKWSKKSMKDRAQHAVILDQEKYDRILKEVPTYRYVSVSVLVDRLKIGGSLARIALRHLEKEGIIKPISKHSKQAIYTRAAASE

SEQ ID NO: 3467 - protein, 59 aa, Oryza sativa
  source: /note="subsp. indica"
MAVPKKRTSMSKKRIRKNLWKKKTYFSIVQSYSLAKSRSFSGVSEHPKPKGFSRQQTNK

SEQ ID NO: 3468 - protein, 53 aa, Saccharomyces cerevisiae
  source: /note="strain ATCC 204508 / S288c"
MRNLHHLRVGHEAHSTHHLWMWKHLRRRAISELRILRNFIRKCIRGGVFLWII

SEQ ID NO: 3469 - protein, 82 aa, Saccharomyces cerevisiae
  source: /note="strain ATCC 204508 / S288c"
MFWEKLEKVSNIMIEKKLVNLDGTSANEENTMKPWQMIKILMDRDLRHAMKEFKLELEKSGIQLGPEQLAPLMTVLGLEKKK

SEQ ID NO: 3470 - protein, 344 aa, Sus scrofa
MVRPKHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGKCKKTCRDVFCPGSSTCVVDQTNNAYCVTCNRICPEPTSSEQYLCGNDGVTYSSACHLRKATCLLGRSIGLAYEGKCIKAKSCEDIQCTGGKKCLWDFKVGRGRCSLCDELCPESKSEEPVCASDNATYASECAMKEAACSSGVLLEVKHSGSCNSISEDTEEEEEDEDQDYSFPISSILEW

SEQ ID NO: 3471 - protein, 105 aa, Gallus gallus
MPKRKAPAEGEAKEEPKRRSARLSAKPAPPKPEPKPKKAAPKKEKAANDKKEDKKAATKGKKGAKGKDETKQEDAKEENHSENGDTKTNEAPAAEASDDKEAKSE

SEQ ID NO: 3472 - protein, 103 aa, Bos taurus
HPVGGPGPVSELPGLQELLDRLRDRVSELQAEQLRVEPLQQGQGLEETWDSPAAAPAGFLGPHHSILRALRGPKMMRDSGCFGRRLDRIGSLSGLGCNVLRRY

SEQ ID NO: 3473 - protein, 57 aa, Coturnix japonica
MARYRRTRTRSRSRRRRRSRRRRSSRRRRYGRSRRSYRSVGRRRRRYGRRRRRRRRY

SEQ ID NO: 3474 - protein, 174 aa, Gallus gallus
MASQKRSSFRHGSKMASASTTDHARHGSPRHRDSGLLDSLGRFFGGDRHVPRRGFGKDIHAARASHVGSIPQRSQHGRPGDDNPVVHFFKNIVSPRTPPPMQAKGRGLSLTRFSWGGEGHKPGYGSGKFYEHKSAHKGHKGSYHEGQGTLSKIFKLGGSGSRPGSRSGSPVARR

SEQ ID NO: 3475 - protein, 155 aa, Ovis aries
MYKIQLLSCIALTLALVANGAPTSSSTGNTMKEVKSLLLDLQLLLEKVKNPENLKLSRMHTFNFYMPKVNATELKHLKCLLEELKLLEEVLDLAPSKNLNTREIKDSMDNIKRIVLELQGSETRFTCEYDDATVKAVEFLNKWITFCQSIYSTMT

SEQ ID NO: 3476 - protein, 130 aa, Glycine max
MTRIKRGYIARKRRTKIRLFTSSFRGAHSRLTRTITQQKIKALVSAHRDRDRKKRDFRGLWISRINAVIRGNIKVYYIYSNLVYSLYTGQLLLNRKIVAQIAILKQNCLFMIANDIIKTKNPLRLYSGKV

SEQ ID NO: 3477 - protein, 47 aa, Triticum aestivum
KICRRRSAGFKGPCMSNKNCAQVCQQEGWGGGNCDGPFRRCKCIRQC

SEQ ID NO: 3478 - protein, 47 aa, Triticum aestivum
KVCRQRSAGFKGPCVSDKNCAQVCLQEGWGGGNCDGPFRRCKCIRQC

SEQ ID NO: 3479 - protein, 116 aa, Bos taurus
MAGLLKKTTGLVGLAVCETPHERLKILYTKILDVLGHIPKNAAYRKYTEQITNEKLSMVKAEPDVKKLEERLQGGQIEEVILQAENELSLARKMIQWKPWEPLVEEPPASQWKWPI

SEQ ID NO: 3480 - protein, 142 aa, Gallus gallus
MQPRGLLLLLALLLLAAAAEAAKAKKEKMKKEGSECQDWHWGPCIPNSKDCGLGYREGSCGDESRKLKCKIPCNWKKKFGADCKYKFESWGGCSAKTGVKTRSGILKKALYNAECEEVVYVSKPCTAKMKAKAKAKKGKGKD

SEQ ID NO: 3481 - protein, 215 aa, Saccharomyces cerevisiae
  source: /note="strain ATCC 204508 / S288c"
MSCTTDKLIQKYDALVRKTTEHKFAKELCAGTLKDRSLYIYLSQDLQFFETSLRLICKTTSLAPTTHALITLAKKIGFFSNDENSYFHDCLELLAPSLTKEERDNFDNKAIPGVDAYINFLDELRKDASITWPSLVTSLWVAEELYWRWARDTPRAPGLHWKYQKWIDLHDGEHFQTWCEFLKAEVDKFPVEEVESIFVKVSQFEFEFFESCYNA

SEQ ID NO: 3482 - protein, 258 aa, Salmo salar
MKFLVLALTILLAAGTQAFPMQADAPSQLEHVKAALNMYIAQVKLTAQRSIDLLDDTEYKEYKMQLSQSLDNLQQFADSTSKSWPPTPRSSAPSCDATATVRAEVMKDVEDVRTQLEPKRAELTEVLNKHIDEYRKKLEPLIKQHIELRRTEMDAFRAKIDPVVEEMRAKVAVNVEETKTKLMPIVEIVRAKLTERLEELRTLAAPYAEEYKEQMFKAVGEVREKVAPLSEDFKARWAPPPRRPSKSSWLSTRPSARP

SEQ ID NO: 3483 - protein, 154 aa, Phoca sibirica
MGLSDGEWHLVLNVWGKWETDLAGHGQEVLIRLFKSHPETLEKFDKFKHLKSEDDMRRSFDLRKHGNTVLTALGGILKKKGHHEAELKPLAQSHATKHKIPIKYLEFISEAIIHVLHSKHPAEFGADAQAAMKKALELFRNDIAAKIKELGFHG

SEQ ID NO: 3484 - protein, 92 aa, Pisum sativum
MTRSRKKNPFVANHLLKKIKKLNTKGEKAIIKTWSRKSTIIPIMIGHTIAIHNGKEHLPVYITDRMVGHKLGEFSPTLNFGGFAKNDNKSRR

SEQ ID NO: 3485 - protein, 222 aa, Spinacia oleracea
MANMLVASSSKTLPTTTTTTITPKPKFPLLKTPLLKLSPPQLPPLKHLNLSVLKSAAITATPLTLSFLLPYPSLAEEIEKASLFDFNLTLPIIMAEFLFLMFALDKIYYTPLGDFMDKRDASIKEQLSGVKDTSSEVKQLEEQANAVMRAARAEISAALNKMKKETQLEVEAKLAEGRKKIEVELQEALGSLEQQKEDTIKSLDSQISALSDDIVKKVLPVS

SEQ ID NO: 3486 - protein, 92 aa, Gallus gallus
MAKRTKKVGIVGKYGTRYGASLRKMVKKIEISQHAKYTCSFCGKTKMKRKAVGIWHCGSCMKTVAGGAWTYNTTSAVTVKSAIRRLKELKDQ

SEQ ID NO: 3487 - protein, 111 aa, Saccharomyces cerevisiae
  source: /note="strain ATCC 204508 / S288c"
MLGRALRPGWLGITRTVVKKPSCGSYFNRTFQTAINTTMPPMQEGMLSTMMMMTATATRITGTVSEPLNGSNIVMQLDSVMRKRKKKMKKHKLRKRRKREKAERRKLSQGR

SEQ ID NO: 3488 - protein, 121 aa, Saccharomyces cerevisiae
  source: /note="strain ATCC 204508 / S288c"
MSNQALYEKLEQTRTILSVKLAELINMTTIADRNDDDEGSFAQENSELAVATTSVMMVNNQTMQLIKNVQDLLILTRSIKEKWLLNQIPVTEHSKVTRFDEKQIEELLDNCIETFVAEKTT

SEQ ID NO: 3489 - protein, 136 aa, Gallus gallus
  MOD_RES (121)..(121): Any amino acid
GKKEKPEKKAKKSDCGEWQWSVCVPTNGDCGLGTREGTRTGAECKQTTKTQKCKIPCNWKKQFGAECKYQFQAWGECDLNTALKTRTGNLKRALHNADCQKTVTISKPCGKLTKPKPQZEXKKKKKEGKKQEKMLB

SEQ ID NO: 3490 - protein, 386 aa, Saccharomyces cerevisiae
  source: /note="strain ATCC 204508 / S288c"
MKVISLKKDSFNKGGAVITLLPEDKEDLFTVYQIVDKDDELIFKKKFTSKLDEAGKKKSTDLVKLKIKVISEDFDMKDEYLKYKGVTVTDESGASNVDIPVGKYLSFTLDYVYPFTIIKQNFNKFMQKLLNEACNIEYKSDTAAVVLQEGIAHVCLVTSSSTILKQKIEYSMPKKKRTTDVLKFDEKTEKFYKAIYSAMKKDLNFDKLKTIILCSPGFYAKILMDKIFQYAEEEHNKKILDNKGMFFIAHCSTGYLQGINEVLKNPLYASKLQDTKYSKEIMVMDEFLLHLNKDDDKAWYGEKEVVKAAEYGAISYLLLTDKVLHSDNIAQREEYLKLMDSVESNGGKALVLSTLHSLGEELDQLTGIACILKYPLPDLDEDDGEE

SEQ ID NO: 3491 - protein, 338 aa, Saccharomyces cerevisiae
  source: /note="strain ATCC 204508 / S288c"
MDKNSVNKDSEEKDERHKIEVVDDTNPDFITADSELTQDLPDDVEVIDLVHLKIKSLEDLNLYRFKNLKQLCLRQNLIESISEVEVLPHDKIVDLDFYDNKIKHISSNVNKLTKLTSLDLSFNKIKHIKNLENLTDLENLYFVQNSISKIENLSTLKSLKNLELGGNKVHSIEPDSFEGLSNLEEIWLGKNSIPRLINLHPLKNLKILSIQSNKLKKIENLEELTNLEELYLSHNFITKIEGLEKNLKLTTLDVTSNKITSLENLNHLSNLTDIWASFNKIDQSFESLGENLSALSRLETIYLEGNPIQLENKTSYRRKLTMNLPPSLQKIDATYIRG

SEQ ID NO: 3492 - protein, 126 aa, Saccharomyces cerevisiae
  source: /note="strain ATCC 204508 / S288c"
MKESLLTLTEKIMFTTTVLKPTITTPITMLITTMRTLVAMKIRHYWKMMAIKDRKIQIPPVKYQMELSIRTLEINLLKNVKETEANLLKRRTDRENKRHYEFGFFYNLRIHNIYIPTSFFFFNSIV

SEQ ID NO: 3493 - protein, 55 aa, Solanum lycopersicum
MAVPKKRTSTSKKRIRKNIWKRKGYWVALKAFSLAKSLSTGNSKSFFVRQTKINK

SEQ ID NO: 3494 - protein, 155 aa, Capra hircus
MYRMQLLSCIALTLALVANGAPTSSSTGNTMKEVKSLLLDLQLLLEKVKNLENLKLSRMHTFNFYMPKVNDTELKHLKCLLEELKLLEDVLDLAPSKNRNTREIKDYMASLKGIVLELQGSETRFTCEYDDATVKAVEFQNKWTTFCQSIYSTLT

SEQ ID NO: 3495 - protein, 68 aa, Equus caballus
MDPETCPCPTGGSCTCSGECKCEGCKCTSCKKSCCSCCPAECEKCAKDCVCKGGEGAEAEAEKCSCCQ

SEQ ID NO: 3496 - protein, 106 aa, Saccharomyces cerevisiae
  source: /note="strain ATCC 204508 / S288c"
MAKSLRASSHLNAKSVKRRGVFQKAVDAREQRISDKLKEDLLKQKLEDLKKKEEQGIDMDVDEKKSNEEAPRKKISTSGWRDGRHHTYKKAKLMKQSKKKTSFTRF

SEQ ID NO: 3497 - protein, 187 aa, Saccharomyces cerevisiae
  source: /note="strain ATCC 204508 / S288c"
MSVSLEQTLGFRIKVTNVLDVVTEGRLYSFNSSNNTLTIQTTKKNQSPQNFKVIKCTFIKHLEVIGDKPSFNSFKKQQIKPSYVNVERVEKLLKESVIASKKKELLRGKGVSAEGQFIFDQIFKTIGDTKWVAKDIIILDDVKVQPPYKVEDIKVLHEGSNQSITLIQRIVERSWEQLEQDDGRKGG

SEQ ID NO: 3498 - protein, 125 aa, Saccharomyces cerevisiae
  source: /note="strain ATCC 204508 / S288c"
MPSKDPESVIDKEIRKISARNDELIKQDGTLKREYTTLLRKVSSVITVLNSIDDADTGSAETELPRLISQATVEKVPELKWYNDQISLITEKLEDDEDIEVPEELMDAYTLYKETPLLYNDTHTP

SEQ ID NO: 3499 - protein, 109 aa, Saccharomyces cerevisiae
  source: /note="strain ATCC 204508 / S288c"
MRFLPRKSRLLMSMRDFYYGLKKLHFCSFPNDIRPPHKKTFLLHSIRSIEAVFGTSDFIKLLGANSTFRLNKLECVENLSSILKKVFALSVINRKLKHLPKATSLPYEK

SEQ ID NO: 3500 - protein, 296 aa, Saccharomyces cerevisiae
  source: /note="strain ATCC 204508 / S288c"
MDYFNIKQNYYTGNFVQCLQEIEKFSKVTDNTLLFYKAKTLLALGQYQSQDPTSKLGKVLDLYVQFLDTKNIEELENLLKDKQNSPYELYLLATAQAILGDLDKSLETCVEGIDNDEAEGTTELLLLAIEVALLNNNVSTASTIFDNYTNAIEDTVSGDNEMILNLAESYIKFATNKETATSNFYYYEELSQTFPTWKTQLGLLNLHLQQRNIAEAQGIVELLLSDYYSVEQKENAVLYKPTFLANQITLALMQGLDTEDLTNQLVKLDHEHAFIKHHQEIDAKFDELVRKYDTSN

SEQ ID NO: 3501 - protein, 144 aa, Ipomoea nil
MKGGKSKAKSDNKLAVKKQAADTKKTKKAVKDPNKPKRPPSAFFVFMEDFRKTYKEKHPNNKSVAVVGKAGGDKWKQLTAAEKAPFISKAEKRKQEYEKNLQAYNKKQAAGAAEEEESDKSRSEVNDDDEDQDGSGEDDSEDDD

SEQ ID NO: 3502 - protein, 149 aa, Vicia faba
MKGGKSKGESKKAETKLAVNKKGAAATKGGKKPAKGKEPKDPNKPKRPPSAFFVFMADFREQYKKDHPNNKSVAAVGKACGEEWKSLSEEEKAPYVDRALKKKEEYEITLQAYNKKLEGKDDEEGSDKSKSEVNDEDEDEEDEEDEDDD

SEQ ID NO: 3503 - protein, 88 aa, Pinus thunbergii
MINNLSISSSLIPDKQRGSVESQVFYLTNRVLRLTQHLQLHGRDYSSQRGLWKILSKRKQLLVYLSKRDKLRYDDLIGQLGIRGLKTR

SEQ ID NO: 3504 - protein, 63 aa, Actinidia deliciosa
MSDKCGNCDCADSSQCVKKGNSIDIVETDKSYIEDVVMGVPAAESGGKCKCGTSCPCVNCTCD

SEQ ID NO: 3505 - protein, 296 aa, Saccharomyces cerevisiae
  source: /note="strain ATCC 204508 / S288c"
MDSLEARLQFIQVLKNLQKTLHKTRDSITSSSTTTPPSSQQKLNNDPIQFYLRNYRHHYEDFHQCLFDTTMKMDPLDRLDVVIYYVRIIRNLYPHSHSNTNVTKVLNEVLLMDIDLVFELCLPCQDWKSLTNQATCKELFLDLSKLIHYDATSVTHTPSDTTLIDATTWYSVKTERTTKDYKESLQRTESLLKDRDLKKLAFFQQFNSDTTAINPDLQTQPTNANILLHRMEADRELHKRSKETSWYIERPSNDILDESEFKSLWTHFETTDSGFDKDDYKNIKALNDIAKASYIY

SEQ ID NO: 3506 - protein, 109 aa, Saccharomyces cerevisiae
  source: /note="strain ATCC 204508 / S288c"
MSQIAQEMTVSLRNARTQLDMVNQQLAYLDRQEKLAELTKKELESYPTDKVWRSCGKSFILQDKSKYVNDLSHAETVLLDQRKTLKIKKNYLETTVEKTIDNLKALMKN

SEQ ID NO: 3507 - protein, 663 aa, Saccharomyces cerevisiae
  source: /note="strain ATCC 204508 / S288c"
MPFQDYFQKKKAAFINRNNKSNADASALRDINDININFAAKSKNYVFPLTKLPDELMQEVFSHLPQPDRLQLCLVNKRLNKIATKLLYRRIYLNDSNVVKSDFMHLAINWTLLNLPSSLKEEESRDIANCKLKKLIETLQNNIHITEVIQWIRINWDLDSTLQRSILSILCNQGKSLQRLENVTDPACNDIISNGHFSRSNVSSFDMAPPNSLPEMVVPENYIPNLTKYLSQRISSRLSHMTLFIDPLKLFNYLYPLDIKLQIIDLKLHWRREFYNNDYFVKKIRPGNPLTKLSEVFDKRTLKILTIISWNDTLLKRETEMLKDFKEFENLEDLSLISIKQDVHILVDLFSSLTNLKRLKMDFLEEYVPEPTNPHIFLSILLACSKLQFIDLRYDGLIPQIINIQENKFQLNQQCNCTNCQIVFSDILKGKIFMFPEDYYIHDLQDIAAKDIFKMMKYLSLLPYSKACDAYPSVRTQPMNLTNFVTKMNRNLLEYRNSKSQLVPKIVNNPHQHSTVTSTSTAHMSEPEMIIIDDDDDDDEINAAIPPSSDDTAATISTDLELPHESLTKRDIIMCYHALIHHFKSIYVTFLKSFPHLRFLMLNDIPTIVMEENNERIFEPVFYHYDYKSNLYGWSKESNKNLENDSNNNNNNSDTIARIATVM

SEQ ID NO: 3508 - protein, 144 aa, Triticum aestivum
MPKNKGKGGKNRKRGKNEADDDKRELVFKEDGQEYAQVTRMLGNGRCEAICVDGTKRLCHIRGKMHKKVWIAAGDIVLVGLRDYQDDKADVILKYMNDEARLLKAYGELPDTVRLNEGVDVDGPEEGEGDSDYIQFEDEDIDKI

SEQ ID NO: 3509 - protein, 344 aa, Bos taurus
MARPRHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELQVQYQGKCKKTCRDVFCPGSSTCVVDQTNNAYCVTCNRICPEPTSSEQYLCGNDGVTYPSACHLRKATCLLGRSIGLAYEGKCIKAKSCDDIQCTGGKKCLWDFKVGRGRCSLCGELCPESKSEEPVCASDNATYASECAMKEAACSSGVLLEVKHSGSCNSISEDTEDEEEDEDQDYSFPISSILEW

SEQ ID NO: 3510 - protein, 417 aa, Saccharomyces cerevisiae
  source: /note="strain ATCC 204508 / S288c"
MDEVLPLFRDSHIPQIKDYQLELQNDLTKTNEAFQKNLLKNYNKILSLTDSVNDLSLNLKNVDQDFKSLCFNDEKFQLNKLTPLPYQTTTHISPPRDEEKVSIPSQNILVISNWTISINNFCNRIVTSTTPSRIFDELLLNFHELSLIPVPSKFEALVKDKCCRLQKFLVDSMKTLNLTLLQWVKLYNLLNTEFSSKWDDDLLSIFNESLFETLFNDNVQALLISSANSKDHQYHSNQQYKDAIVVDFVNSSTFRDHLIRRTVKEINTHLDTLSTLRAKLKEPETLHKLDIFHDNDTNLNDGTVSPLDDDALKQYIDTAVFYSKGLTNDTTLQIYQTVQPTIEILQNLELYKCPQETLTDLRNKLITQLQEFKTQISSRLPSPLENSTSVVDDFITSYNNHNLLQLVIDQITQLRQQ

SEQ ID NO: 3511 - protein, 271 aa, Saccharomyces cerevisiae
  source: /note="strain ATCC 204508 / S288c"
MGLAATRTKQRFGLDPRNTAWSNDTSRFGHQFLEKFGWKPGMGLGLSPMNSNTSHIKVSIKDDNVGLGAKLKRKDKKDEFDNGECAGLDVFQRILGRLNGKESKISEELDTQRKQKIIDGKWGIHFVKGEVLASTWDPKTHKLRNYSNAKKRKREGDDSEDEDDDDKEDKDSDKKKHKKHKKHKKDKKKDKKDKKEHKKHKKEEKRLKKEKRAEKTKETKKTSKLKSSESASNIPDAVNTRLSVRSKWIKQKRAALMDSKALNEIFMITND

SEQ ID NO: 3512 - protein, 189 aa, Saccharomyces cerevisiae
  source: /note="strain ATCC 204508 / S288c"
MLEAKMVMVVPTIEDQAMIVLHPKILSQSVVMHIKGQNYQLDLVKVKHIMIEVGHLDPQVRTGAMVLIKGITAYVKSIRKTVHNVHNYGFLKSHFKRAKTAAKPTLTKLHLTSATRLQKMKKSRIKDSRRMKQLETNFKRKIIEIHEIAVLPIEPMKIKGTTEIERAILRRFRKVPRVGITSVGTRGNY

SEQ ID NO: 3513 - protein, 246 aa, Saccharomyces cerevisiae
  source: /note="strain ATCC 204508 / S288c"
MESIFGGFGDLVVPRPKEHLGQTDLSFGGKLLPALKICEDGGESGCGGKVWIAGELLCEYILEKSVDHLLSKTVNGTKQFKKVLELGSGTGLVGLCVGLLEKNTFHDGTKVYVTDIDKLIPLLKRNIELDEVQYEVLARELWWGEPLSADFSPQEGAMQANNVDLVLAADCVYLEEAFPLLEKTLLDLTHCINPPVILMAYKKRRKADKHFFNKIKRNFDVLEITDFSKFEHYLKERTHLFQLIRK

SEQ ID NO: 3514 - protein, 68 aa, Sus scrofa
MDPETCPCPTGGSCTCAGSCKCEGCKCTSCKKSCCSCCPAECEKCAKDCVCKGGEGAEAEEEKCSCCQ

SEQ ID NO: 3515 - protein, 93 aa, Triticum aestivum
MTRKKTNPFVAHHLLAKIEKVNMKEEKETIVTWSRASSILPTMVGHTIAIHNGKEHIPIYITNPMVGRKLGEFVPTRHFTSYENARKDTKSRR

SEQ ID NO: 3516 - protein, 298 aa, Lactobacillus johnsonii
MNKTWKKAATVLAFAGIALSATACSGGKAVVTYKGGKITESQYYDKMKESQAGQSTLASMIVSDALESQYGKDVTQKQVDKEYNKYKKQYGSQFDSVLEQNGMTASTFKDNLKTNLLTEAALKHIKKITPAQEKKAWKNYQPEVTVQHILVSKKSTAEDVIKQLQDGGDFKKLAKKYSTDTATKNDAGKLPAFDSTDSTLDSSFKTAAFKLKTGEITTTPVKTQYGYHVIKMIKHPAKGTFKEHKKQIDNQIYQSMSEDQNVMRSVIATVLKRADVSIKDKDLKNVLSQYVSSDSLSK

SEQ ID NO: 3517 - protein, 52 aa, Brassica rapa
MAVPKKRTSISKKRIRKKIWKRKGYWTSLKAFSLGKSLSTGNSKSFFVQQNK

SEQ ID NO: 3518 - protein, 154 aa, Phoca vitulina
MGLSDGEWHLVLNVWGKVETDLAGHGQEVLIRLFKSHPETLEKFDKFKHLKSEDDMRRSEDLRKHGNTVLTALGGILKKKGHHEAELKPLAQSHATKHKIPIKYLEFISEAIIHVLHSKHPAEFGADAQAAMKKALELFRNDIAAKYKELGFHG

SEQ ID NO: 3519 - protein, 180 aa, Lactobacillus plantarum
MAREVVDAMTMRRALTRITYEIIEQNKGVGNLVFIGIKTRGIFLAQRLAQRLKQLEGVDVPVGSLDITLYRDDHHAVDVAGQAKLNGADIPVDINGKHVILVDDVLFTGRTVRAALDALMDHGRPAKISLAVLVDRGHRELPIRPDFIGKNIPTALDEQVSVALEEHDGHDGISIEKLEE

SEQ ID NO: 3520 - protein, 90 aa, Sus scrofa
MPKRKAEGDAKGDKAKVKDEPQRRSARLSAKPAPPKPEPKPKKAPAKKGEKVPKGKKGKADAGKDGNNPAENGDAKTDQAQKAEGAGDAK

SEQ ID NO: 3521 - protein, 97 aa, Zea mays
EVASDDVAAEEAAAAPKIGRRVRVTAPLRVYHVLKAPDLDIQGMEGVVKQYVCVWKGKRVTANFPFKVEFELAVEGQPKPVRFFAHLREDEFEFVDG

SEQ ID NO: 3522 - protein, 171 aa, Sus scrofa
ASQKRPSQRHGSKYLASASTMDHARHGFLPRHRDTGIDSLGRFFGADRGAPKRGSGKDGHHAARTTHYGSLPQKAQHGRPQDENPVVHFFKNIVTPRTPPPSQGKGRGLSLSRFSWGAEGQKPGFGYGGRAPDYKPAHKGLKGAQDAQGTLSKIFKLGGRDSRSGSPMARR

SEQ ID NO: 3523 - protein, 46 aa, Beta vulgaris
ATCRKPSMYFSGACFSDTNCQKACNREDWPNGKCLVGFKCECQRPC

SEQ ID NO: 3524 - protein, 87 aa, Bos taurus
MAKHLKFIARTVMVQEGNVEGAYRTLNRILTMDGLIEDIKRRRYYEKPCRRRQRESYETCRRIYNMEMARKINFLMRKNRADPWQGC

SEQ ID NO: 3525 - protein, 172 aa, Equus caballus
ASQKRPSQRHGSKYLASASTMDHARHGFLPRHRDTGILDSLGRFFGGDRGVPKRGSGKDGHHAARTTHYGSLPQKSRDGRPQDENPVVHFFKINVTPRTPPPSQGKGRGLSLSRFSWGAEGQKPGFGYGARASDYKSTHKGLKGVHDAQGTLSRIFKLGGRDSRSGSPMARR

SEQ ID NO: 3526 - protein, 154 aa, Bubalus bubalis
MGLSDGEWQLVLNAWGKVETDVAGHGQEVLIRLFTGHPETLEKFDKFKHLKTEAEMKASEDLKKHGNTVLTALGGILKKKGHHEAEVKHLAESHANKHKIPVKYLEFISDAIIHVLHDKHPSDFGADAQAAMSKALELFRNEMAAQYKVLGFHG

SEQ ID NO: 3527 - protein, 137 aa, Bos taurus
MGAHLARRYLGDASVEPDPLRMPTFPPDYGFPERKEREMVATQQEMNDAQLVLQQRDYCAHYLIRFLKCKRDSFPNFLACKHERHDWDYCEHLDYVKRMKEFERERRLLQRKKRREQREADMAKGLGPGEVAPEVAL

SEQ ID NO: 3528 - protein, 229 aa, Lactobacillus casei
  source: /note="strain ATCC 334"
MDQNKLKQEAAQRAAEFVEDGMTIGLGTGSTVVYLVEAIAQRIKDEHLNLTGVATSVRTRKQAESLGIPMKALDEVGQIDLTIDGADEVDKHFQGIKGGGRSHLIEKIVAINSARNIWIVDETKLVDTLGKFPLPLEVIPFGSGKLLQRLADEGLKPAYRLNEDGSKALTDSKNYIIDLHLGKIEHPHLLAEWLNKQVGIVEHGLFLDLVKTVVVGTTHGPEILDAHRG

SEQ ID NO: 3529 - protein, 132 aa, Lactobacillus casei
  source: /note="strain ATCC 334"
MVLTDPIADYLTRIRNANMVRHESLVVPASKMKKDISEILKREGFIRDYEVIDDDKQGVIRIFLKYGKNNERVISGLKRISKPGLRSYVKSDAVPKVLNGLGIAIISTSEGVITDKEARAKNVGGEVLAYVW

SEQ ID NO: 3530 - protein, 211 aa, Saccharomyces cerevisiae
  source: /note="strain ATCC 204508 / S288c"
MDSKEYLISYGWKEGEAFREGGLKRPILVKHKRDKKGLGNAPGGNDGEAWWERLFDGHLKNLDVSTDSNNGSIKFTQNEAVATAVSKSSSPLYRWFVKGEGLKGTITNLGKKEEASFVVSSASSSKGKKRRRRDEDDNKVKRKKLKKDKKTSNDSESKKKKKKKSKKESKKGKKSKHSSDEGDKSKHKKSKKSKKHKKEESSARRDRKEHI

SEQ ID NO: 3531 - protein, 61 aa, Lactobacillus casei
  source: /note="strain ATCC 334"
MAKDIITGRHTTFGNKRSHALNSSRRQWKANLHKVRILVDGKPKRVWVSARALKSGKLTRV

SEQ ID NO: 3532 - protein, 77 aa, Saccharomyces cerevisiae
  source: /note="strain ATCC 204508 / S288c"
MIVKVKTLTGKEISVELKESDLVYHIKELLEEKEGIPPSQQRLIFQGKQIDDKLTVTDAHLVEGMQLHLVLTLRGGN

SEQ ID NO: 3533 - protein, 157 aa, Lactobacillus casei
  source: /note="strain ATCC 334"
MAKKHRQKPDNLLAQNKKAGHDYNILDTYEAGIALTGTEIKSVRDGKLNLRDGFARIRNNEAWLENVHISPYKEGNLFNVDPMRNRKLLLHKREIRKLGQMTARQGVTLVPLRMYLKHGYAKVLIGVAEGKHNYDKRETLKRKDQEREVQRALKARY

SEQ ID NO: 3534 - protein, 106 aa, Lactobacillus casei
  source: /note="strain ATCC 334"
MANNEHVTPGEDDQQITLIDEKGNEELYQVLFTFDSEDYGKSYVLLYPASESDDQEVEIQAFSFTPDENGDASSGDLFPIDDDAEWDMVEEVLNTFLADDDSNLKD

SEQ ID NO: 3535 - protein, 250 aa, Lactobacillus gasseri
  source: /note="strain ATCC 33323 / DSM 20243"
MVRELCEVQGLIFKRKKYKEADILTKIMTKDHGIFTIDVRGALRPKSRLGAATLNFSYGKYIVNTNWKGISSLRTFKDVKQLDQLYLDLTKNAYSSYVLDLLDHAFVEYKDIGSFYDLIMKALLKINSGEDVAVITQMVQLKLLNAYGVAPQLDRCLICGKVQGTFDYSLELGGIICSDHFNSVSQRMHLDPKVVALIRTLALIDIDRLGKVKINPQLKKNSGKVIDRMYANYLDLNLKTKKFLDELALF

SEQ ID NO: 3536 - protein, 349 aa, Lactobacillus gasseri
  source: /note="strain ATCC 33323 / DSM 20243"
MTAQINLKDITVQFGPNKAVNNVNLEINKGDIYGVIGFSGAGKSTLVRTINLLQYPSAGSVEVNGTILFKEGKLQVSKKQLQEKRRKIGMIFQNFNLLNEETVIENVAFALQHTHLSDKELEEKSLHLLELVGLKDKSDFYPAQLSGGQRQRVAIARALANDPDILISDEATSALDPKTTNQILDLLYDLNKKLGLTIVLITHEMDAVKRVANKIAVMEKGKVIEKGDLREVFLHPQKQLTRQFVGGALQAQHILNTYNFDKLADNAELYQLVYSINDVTKSVVADLDVSLNTKASILYGNVEVLSGEPIGTLAILLNLDEQKQKEAIKFLESKNVVVTKLDKGVLTND

SEQ ID NO: 3537 - protein, 104 aa, Lactobacillus gasseri
  source: /note="strain ATCC 33323 / DSM 20243"
MSEKINANQDNDRQITLVDDQGNEELFEILFTFTSEDYGKSYVLLYPAAVSDDDDVEVQAFSYDADEDGDVTSSDLHEISDDDEWNMVQGVLNTFLSDDRLSGE

SEQ ID NO: 3538 - protein, 73 aa, Lactobacillus gasseri
  source: /note="strain ATCC 33323 / DSM 20243"
MAKEDVIEVEGKVVDTLPNAMFKVELENGATILAHVSGKIRMHYIRILPGDRVTVELSPYDLTKGRITYRFIK

SEQ ID NO: 3539 - protein, 349 aa, Saccharomyces cerevisiae
  source: /note="strain ATCC 204508 / S288c"
MSPLNVGIVGTGIFARDRHLPSYQEFPDKFKVIAAFNRHKAKALDFAKVADIPENKVYDNLDEILNDPHVDYIDALLPAQFNADIVEKAVKAGKPVILEKPIAANLDQAKEIVKIAESTPLPVGVAENWLYLPCIKIAKEQIEKIGPVVAFTHNSTGPFVTQNKYLTTTWRQKPEHIGGFLSDGGVHQLALVISLLGEFGSVSALTRQVRERSGADDIVFATVQLKNKEVIGSFTYGSAFGATEKSVFLKVYGKNGTVTVDLSDKKDPVVKVKLGGSAEDNGDEQIFKVDNDESFGVNAEFLNFHEAVSKKDKSLYLGTPRTAFHHLACVDAFLKSSAKNGDYVKIEQP

SEQ ID NO: 3540 - protein, 107 aa, Lactobacillus delbrueckii
  source: /note="subsp. bulgaricus"
  source: /note="strain ATCC BAA-365"
MAFEVSAEDQDRQLTLIDEDGNEELFEVLFTFHSDDNDKSYILLYPAAVEDDDEIEVQAFSYDADEDGDVTSSDLHEITSDAEWDMVQGVLNTFLEDDRLSGDDSAE

SEQ ID NO: 3541 - protein, 205 aa, Saccharomyces cerevisiae
  source: /note="strain ATCC 204508 / S288c"
MRWWPWSNQTEDQKQQQQPQGKADGDRVLTNYSRGQKILLEDTPPKFADDLSNSQLAKKQERATLKEAWDSIRWSDFSLQKLTSIPCFRDAGMLGFSSMFLMGSIIFIYHKSPTKATNWAMSSLILGSIVGWEQCRLKRQKSFQIAQLAKETVAKKEKPMLHNVPHDPSLPGQWEAAKNEKQSQFEQSNQNLSQASSEKKWYKFW

SEQ ID NO: 3542 - protein, 283 aa, Lactobacillus delbrueckii
  source: /note="subsp. bulgaricus"
  source: /note="strain ATCC BAA-365"
MGEILDGKKLARELGEKLGSEVDSLKEHGVSPKLCVINIGDDPASKVYVASKKRKAEKLGIKQVVYQLPADESEEDVLKLIDSLNADPEVSSLMVQLPVPPQINADRVIERIDPEKDVDCLTPANIGRLWQGKHFVEPATAAGIIALLDHYQIDLTGKNAVIVGRSNIVGKPLAALMLERNASVSILHSRSRNLADLTKQADILVCAVGKAEMIKADMVKEGAVVIDVGINRVDGHLVGDVDFAPVKEKASWITPVPGGVGPLTVEFLMEEVIKLTRRQHGLD

SEQ ID NO: 3543 - protein, 189 aa, Lactobacillus delbrueckii
  source: /note="subsp. bulgaricus"
  source: /note="strain ATCC BAA-365"
MGLADFKDVDRNELSMIEVAHAILEDRGERMAFADIVNEVQKYLNKSDEEIRQRLPQFYTDMNTDGRFISMGENVWALRTWFKFEAVDEEVDHPEDDGDEESTRKHHKKVNTFLATTEGDDVIDYENDDPEDEDLSDDSDADEDDADDNSGDDYDDNEDDDDDDSLLDGIEDQLSQMDDDDLDDDEDEE

SEQ ID NO: 3544 - protein, 135 aa, Pisum sativum
MVKFLKPNKAVILLQGRYAGKKAVIVKTFDDGTREKPYGHCLVAGIKKFPSKVIKKDSAKKTAKKSRVKAFVKLVNYQHLMPTRYTLDVDLKDAVVPDVLQSKDKKVTALKETKKSLEERFKTGKNRWFFTKLRF

SEQ ID NO: 3545 - protein, 59 aa, Zea mays
MAVPKKRTSMSKKRIRKNLWKKKTYFSIVQSYSLAKSRSFSRGNEHPKPKGFSGQQANK

SEQ ID NO: 3546 - protein, 122 aa, Saccharomyces cerevisiae
  source: /note="strain ATCC 204508 / S288c"
MFLTFSMCVNWIIVKMPNRSEELDRLLDKIINSPHRTEASKTLQEIENNQSYILNVQLKKLLRLHDDSFKNKCVSPINYMLEKYTPYMGHTEALQKEAELVDRDLRILEMTYQLIEKNRNSK

SEQ ID NO: 3547 - protein, 153 aa, Saccharomyces cerevisiae
  source: /note="strain ATCC 204508 / S288c"
MNSEQLLHNYVSDSLLTTLISFQEFKQQLQSYTSDEQQLQHWYELLQARDARVTSELEARIKQFFITLRSRLLRFLESEQLSHSLSLETLIDALYKINDLLQQRLQILDDAIQEKTSELAEFENMVRSPSAGDNAIPGLLQIIQSYINLLEEN

SEQ ID NO: 3548 - protein, 107 aa, Saccharomyces cerevisiae
  source: /note="strain ATCC 204508 / S288c"
MSRHQFDLIMCLKQPGVQTGLLCEKCDGKCPICDSYVRPKRKVRVCENCSFGKQAKNCIICNLNVGVNDAFYCWECCRLGKDKDGCPRILNLGSNRLDRHFEKKKKV

SEQ ID NO: 3549 - protein, 181 aa, Saccharomyces cerevisiae
  source: /note="strain ATCC 204508 / S288c"
MPYKTAIDCIEELATQCFLSKLTDDDVSTFRRVCSKENDIIKLALRIPRTIDYTSILRLLYDTLPLRSLSFNEALPLFCYSIDPAQQRQCDLRFYLRDVVKLARPRKRLEMQKALLQWLPSLLSDVTLQLLNDIRIRFEEIQPNIRQTVLQIYDRTCYPSLNFEHPNLGVFPETDSIFEPV

SEQ ID NO: 3550 - protein, 121 aa, Saccharomyces cerevisiae
  source: /note="strain ATCC 204508 / S288c"
MSNEVDRMDVDEDESQNIAQSSNQSAPVETKKKRFEIKKWTAVAFWSWDIAVDNCAICRNHIMEPCIECQPKAMTDTDNECVAAWGVCNHAFHLHCINKWIKTRDACPLDNQPWQLARCGR

SEQ ID NO: 3551 - protein, 113 aa, Saccharomyces cerevisiae
  source: /note="strain ATCC 204508 / S288c"
MKLVLFKIAVALLYLLSFFLHRLHLRLRHLHRRRRRRHHRRHHRRHHHHRRRRRRRRRRRRRHHRHHHHRHRRRRHYLHLYHQYRSSYYHPPHRYLHPLLLPFPQKHRDNHLV

SEQ ID NO: 3552 - protein, 45 aa, Citrus sinensis
MLLLKHRRIEILDQNTMYGWYELLKQEFLNSEPPELLLTTSKNFH

SEQ ID NO: 3553 - protein, 136 aa, Citrus sinensis
MGKDTIADIITSIRNADMNRKGTVRIASTNITENVVKILLREGFIENARKLVENKNKKEFLVLTLRHRRNRKGPYRPILNLKRISRPGLRIYFNYRRIPRILDGMGIVILSTSRGIMTDRAARLERIGGEILCYIW

SEQ ID NO: 3554 - protein, 117 aa, Citrus sinensis
MTRIRRGYIARRRRTKMRLFVSSFRGAHSRLSRTITQQKIRALVSAHRDRDRKKRDFRRLWITRINAVIRGNLVSYSYSRLIYNLYKAQLVLNRKILAQIAISNRNCLYMISNEIIK

SEQ ID NO: 3555 - protein, 222 aa, Bos taurus
MFPFKVRKWMGLACFRSLVVSSSSIRQKKLIHKLQEEKAFREEMRHFREKIEDFREEMWNFRSKMRAFRGEILGFWEEDRLFWEEEKTFWKEEKAFWEMEKSFREEEKAFWKKYRIFWKEDRAFWKEDNALWERDRNLLQEDKALWEEEKALWVEERALLEEEKVLWEDKKTLWEEENALWEEEKAAWVEGVVPVVEQQVLEGGHHHVSGRPRSPASSRGRA

SEQ ID NO: 3556 - protein, 156 aa, Bos taurus
MMVLDKEDGVPMLSVQPKGKQKGCAGCNRKIKDRYLLKALDQYWHEDCLKCACCDCRLGEVGSTLYTKANLILCRRDYLRLFGTTGNCAACSKLIPAFEMVMRARDNVYHLDCFACQLCNQRFCVGDKFFLKNNMILCQMDYEEGQLNGTFDSHVQ

SEQ ID NO: 3557 - protein, 208 aa, Bos taurus
MEAPPVTMMPVTGGTINMMEYLLQGSVLDHSLESLIHRLRGLCDNMEPETFVDHEMVFLLKGQQASPFVLRARRSLDRAGAPWHLRYLGQPEMGDKNRHALVRNCVDIATSENLTDFLMEMGFRMDHEFVARGHLFRKGIMKIVVYKIFRILVPGNTDNTEALSLSYLVELSVVAPAGQDMVSDDMRNFAEQLKPLVHLEKIDPKRLM

SEQ ID NO: 3558 - protein, 146 aa, Bos taurus
MTLTKGSFTYSSGEEYRGEWKEGRRHGFGQLMFADGGTYLGHFENGLFNGFGVLTFSDGSRYEGEFAQGKFNGVGVFIRHDNMTFEGEFKNGRVDGLGLLTFPDGSHGIPRNEGLFENNKLLRREKCSAVVQRAQSASKSARSLTA

SEQ ID NO: 3559 - protein, 832 aa, Saccharomyces cerevisiae
  source: /note="strain ATCC 204508 / S288c"
MGSSLRSFIKDVRGAKTLADERAIITKQSAKIRTKLRDDHLPHEKRRVNIQKLLYLYILGEKTHFGQVESINLIASDDFVDKRLGYLAATLLLDESEDLLTLLTNMLNNDLHHPNKYAVSLALTSLGFLSSPELARDLYPDVENIIKNSRDPFLLKKALQCAAKLIFKDVSLLEIFNIEDITKILSSHSICTHGVLLGVTKIIQSILLIGLNRKKDEDEDEDGIDYSNDILSPLSLLLRDFFIRLENMNSKNIEPGYDVQGICDPFLQCEIIYTLKLYFQVGELLNSNNVLDYKDNFCDLLTRIATNTDSTKNSGQAILYETVKTIFSLDLNQPLRVLGINILAKFLAGKDNNTKYVSLNTLLKVVPQEPTAVQRHRKFISHCLQDTDVSIRMRALELSFAILDDSNLVELVNELMKFLAKQDEDSKDLIIYTIDHLIDTFDTRVVKDESWKLDVFFNILKLVGSFINYEKINDILIIINNTSQLSDKSEFLRKMLTISLNGTSAEISEENIGWQLVLIWCIGEYGDLVLNEGNKNGADIINESSITDYLLTLQELYTATNLKIINYILTAALKLSVRFHDAKNIEKLRQLILSYTDSTDLSLQMKSNQYEIFFNQSISVKKIILETMPKFEKITEEQDNGKALSKNLISNEPVDLLSDLLGEDSKAESKASTGDNVKPIDILEEIFGEKNDIAQVPKNANKEESINHSSAVEANSGVTLPLDANKIYDSSSLNVYASLLSANSGLAHLDLYFQAKSLISDLKTFCAVPKAQKLTLGQLYPSSTINASQICKQSLKISGSGKLKLRVKLDFHLNGSSSITNEQFDHKFDETL

SEQ ID NO: 3560 - protein, 117 aa, Populus alba
MTRIRRGYIARRRRTKIRLFTSSFRGAHSRLTRTIIQQRIKALFSAYRDRDRHKRNFRCLWVTRINAAIRENAVSYSYSTLINNLYKRQLLLNRKILAQLAILNRNCLYLISNDMIK

SEQ ID NO: 3561 - protein, 85 aa, Bos taurus
MPMVTRRLRDPDVNPCLSESDASTRCMAENNYDKESCSSHFLKYKNCRKFWNSVMIQRRQNGVKPPMPTAAERDEILGGLGKMPY

SEQ ID NO: 3562 - protein, 197 aa, Lactobacillus delbrueckii
  source: /note="subsp. bulgaricus"
  source: /note="strain ATCC 11842 / DSM 20081"
MYEYFEGTITVVNPAYVVIEVAGIGYRILTPTPYAYKDGDKARIYVEQVVRENGMTLYGFKSQQDKVLFNKLNEVSGIGPKSALAIMAAEDNGALASAIESGEVSYLTRFPGIGKKTASQIVLDLRGKMGNYVAENLFTEDEPVKSVFPALEDALLALGALGYSQKEVDRIKPKLKKLPEMSADEYIKQGLGFLLKK

SEQ ID NO: 3563 - protein, 61 aa, Lactobacillus delbrueckii
  source: /note="subsp. bulgaricus"
  source: /note="strain ATCC 11842 / DSM 20081"
MAKDFVTGKKTTFGNTRSHALNSSSRSWKPNLQKVRILVNGKPKRVWVSTKTLKSGKVTRV

SEQ ID NO: 3564 - protein, 189 aa, Lactobacillus delbrueckii
  source: /note="subsp. bulgaricus"
  source: /note="strain ATCC 11842 / DSM 20081"
MGLADFKDVDRNELSMIEVAHAILEDRGERMAFADIVNEVQKYLNKSDEEIRQRLPQFYTDMNTDGRFISMGENVWALRTWFKFEAVDEEVDHPEDDGDEESTRKHHKKVNAFLATTEGDDVIDYENDDPEDEDLSDDSDADEDDADDNSGDDYDDNEDDDDDDSLLDGIEDQLSQMDDDDLDDDEDEE

SEQ ID NO: 3565 - protein, 279 aa, Bos taurus
MTERFDCHHCEDSLFGRKYVLREEQPYCVACFEALFASTCEECGKLIGCDCKDLSYKDRHWHEACFHCSRCRGSLVDKPFAAKEDQLLCTDCYSQEYSSRCQECKKSIMPGTRKMEYKGSSWHETCFICHRCQQPIGTKSFIPKDSENFCVPCYERQYALQCVQCKKPITTGGVTYREQPWHRECFVCTACKKPLSGQRFTSRDEFAYCLGCFCDLYAKKCAGCANPISGLGGTKYISFEERQWHNDCFNCKKCSLSLVGRGFLTERDDILCPDCGKDI

SEQ ID NO: 3566 - protein, 145 aa, Bos taurus
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKFFLKNNMILCQTDYEEGLMKEGYAPQVR

SEQ ID NO: 3567 - protein, 351 aa, Bos taurus
MRPPAPAVLGLLLLLLPTGEATKKPTPCKRCRELVDKFNQGMVDTAKKNFGGGNTAWEEKTLSKYEFSEVRLLEIVEGLCEASDFECNQLLEEQEELLEAWWLRLKKKHPDLFEWFCVQTLKACCSPGTYGPDCLACQGGSERPCSGNGHCVGDGTREGDGSCQCHLGYQGPLCSDCMDGYFRSPTSETHSICSACDEACKTCVGPTNRDCGQCEVGWVRQDDACVDVDECAAEPPPCEDTQYCENVNGSFVCEECDPTCMGCTGKGPTQCRECIAGYSKESGQCEDIDECSLAEKPCLRDNENCYNTPGSFVCVCPDGFEEAEDTCVQTRPAGAEATEASPTQPPSREDL

SEQ ID NO: 3568 - protein, 117 aa, Gossypium hirsutum
MTRIKRGYIARRRRKKISLFASSFRGAHSRLTRTITQQRIRALVSAHRDRDRKKRDFRRLWITRINAVIRGVGVSYSYSRLIHNLYKKQLLLNRKILAQIAISNRNCLYMISNEIRK

SEQ ID NO: 3569 - protein, 108 aa, Bos taurus
MLLFCPGCGNGLIVEEGQRCHRFACNTCPYVHNVTRKVTNRKYPKLKEVDDELGGAAAWENVDSTAEPCPKCEHPRAYFMQLQTRYADEPMTTFYKCCNAQCGHRWRD

SEQ ID NO: 3570 - protein, 92 aa, Solanum lycopersicum
MTRSLKKNPFVANHLLKKIDKLNTKAEKEIIVTWSRASTIIPTMIGHTIAIHNGKEHLPIYITDSMVGHKLGEFAPTLNFRGHAKSDNRSRR

SEQ ID NO: 3571 - protein, 68 aa, Bos grunniens
MDPETCPCPTGGSCTCSDPCKCEGCTCASSKKSCCSCCPAECEKCAKDCVCKGGEGAEAEEKKCSCCQ

SEQ ID NO: 3572 - protein, 165 aa, Bos taurus
MFLTVKLLLGRRCSLKVSGQESVAMLKKLVSERLHVPEEQQHLLFRGQLLADDKRLSDYRIGPNASISVVVRPLEKPAPEDTRLPQPLWHHLGQVLAKHFGPQDTEAMLQLLRREHEECLQRISLGDLEQLARYLLTKEPLAQPTGEREPEVLSPNKEEEKEAVQ

SEQ ID NO: 3573 - protein, 127 aa, Bos taurus
MAKSLRSKWKRKMRAEKRKKNAPKELSRLKSILKIDGDVLMKDVQEIATVVEPKHCQEKTQCVVKDETDDMKMETDIKRNKKTLLDQHGQYPIWMNQRQRKRLKAKRERKKGKSKVKAMKAAKGLTW

SEQ ID NO: 3574 - protein, 284 aa, Bos taurus
MTTPQFYCQYCMASLLGKKYVLKDDNPYCVSCYDRIFSNYCEECKEPIESGSKDLCYKGHHWHEGCFNCTKCNHSLVEKPFAAKDERLLCSECYSNECSSKCFHCKKTIMPGSRKMEFKGNYWHETCFVCEHCRQPIGTKPLISKESGNYCVPCFEKEFAHYCSFCKKVITSGGITFRDQPWHKECFLCSGCRKELCEEEFMSRDDYPFCLDCYNHLYAKKCAACTKPITGLRGAKFICFQDRQWHSECFNCGKCSVSLVGEGFLTHNKEIFCRKCGSGVDTDI

SEQ ID NO: 3575 - protein, 101 aa, Bos taurus
MSMEKMGKVEEHFQRALELKKMVHRWRNSHTHCLWQITLSQRRNPYAILRMQDTMVQELALANKQLLMVRQAALHQLFEKEHQQYQQELNEKGKAFYMERL

SEQ ID NO: 3576 - protein, 339 aa, Bos taurus
MKDSLVLLSRILAHPDSRCWFLAWNPAGTLLASCGGDRSVRIWGREGDSWICKSVLCEGHQRTVRKVAWSPCGNYLASASFDATTCIWKKNEDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGVACSGSEASWKCVCTLSGFHSRTIYDVAWCQLTGTLATACGDDAIRVFEEDPGSDPQQPTFSLTAHVPQAHSQDVNCVAWNPKERGLLASCSDDGELAFWKYQPSEGI

SEQ ID NO: 3577 - protein, 92 aa, Lactuca sativa
MTRSLKKNPFVANNLLKKINKLNTKAEKEIIITWSRASTIIPIMVGHTIAIHNGKEHLPIYITDRMVGHKLGEFAPTLNFRGHAKSDNRSRR

SEQ ID NO: 3578 - protein, 37 aa, Lactuca sativa
MKIRASVRKICEKCRLIRRRGRIRVICSNPRHKQRQG

SEQ ID NO: 3579 - protein, 98 aa, Saccharomyces cerevisiae
  source: /note="strain ATCC 204508 / S288c"
MSGNPGSSLSALRPTPPERGSFPLDHDGECTKYMQEYLKCMQLVQNENAMNCRLLAKDYLRCRMDHQLMDYDEWSHLGLPEDAPGNNGKTIKDATDNK

SEQ ID NO: 3580 - protein, 38 aa, Saccharomyces cerevisiae
  source: /note="strain ATCC 204508 / S288c"
MNVIFKLYLTIDAPKKKKVTVRDFLSIRYSMPYRLASN

SEQ ID NO: 3581 - protein, 85 aa, Saccharomyces cerevisiae
  source: /note="strain ATCC 204508 / S288c"
MPQKPLKVTKKAKDPRRVTKKQKNLRKAAPLQLKSKKKSLQHLKKLKKSSSLTETTERLVASKVGHLELLRGTRKELEKGKKNSK

SEQ ID NO: 3582 - protein, 53 aa, Saccharomyces cerevisiae
  source: /note="strain ATCC 204508 / S288c"
MHILTRSSKNAFPRSRSRQDIHISSHIHRDTSNSALLKILVITRTRLDSFVKT

SEQ ID NO: 3583 - protein, 49 aa, Saccharomyces cerevisiae
  source: /note="strain ATCC 204508 / S288c"
MWRRRREPWEELSFLLNSLSPRNWFIRRWGLMAGRGQHLCWLRCACDGP

SEQ ID NO: 3584 - protein, 45 aa, Saccharomyces cerevisiae
  source: /note="strain ATCC 204508 / S288c"
MKMNYHLSTSSYTTSMLSCTVLDDDIRYEKLSWKLDEAEMQGLIM

SEQ ID NO: 3585 - protein, 104 aa, Bos taurus
MAEGEGWRPPRPCEAYRAEWELCRSAGHFLRHYYVHGERPACGQWRRDLASCREWEERRSAEAQADSLPPGPEGEPRVAGAGPNAVTGILTRNQGTERPHGDTR

SEQ ID NO: 3586 - protein, 170 aa, Bos taurus
MSSNECFKCGRSGHWARECPTGGGRGRGMRSRGRGFQFVSSSLPDICYRCGESGHLAKDCDLQEDACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 3587 - protein, 148 aa, Bos taurus
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 3588 - protein, 73 aa, Bos taurus
MIEVVCNDRLGKKVRVKCNTDDTIGDLKKLIAAQTGTRWNKIVLKKWYTIFKDHVSLGDYEIHDGMNLELYYQ

SEQ ID NO: 3589 - protein, 86 aa, Bos taurus
MSLPLNPKPFLNGLTGKPVMVKLKWGMEYKGYLVSVDGYMNMQLANTEEYIDGALSGHLGEVLIRCNNVLYIRGVEEEEEDGEMRE

SEQ ID NO: 3590 - protein, 92 aa, Acorus calamus
MTRSLKKNPFVANHLLEKIEKLNMKEEKEIIVTWSRASTIIPTMIGHTIAIHNGKEHLPIYITDRMVGHKLGEFAPTLTFRGHARNDNKSRR

SEQ ID NO: 3591 - protein, 139 aa, Bos taurus
MLPLSLLKTAQNHPMLVELKNGETYNGHLVSCDNWMNINLREVICTSRDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 3592 - protein, 177 aa, Lactobacillus johnsonii
MTKYSTELKIEIVSKYLNHEDSIKGLAKQYNIHWTLIRRWVDKAKCQGLAALSVKHTKTTYSSDFKLNVVRYYLTHSIGVSKVAAKFNISDSQVYNWAKKFNEEGYAGLLPKQKGRPRKVPKKSKKTTKKLELSEKQKYEEKILKQEAELERLRVENLVLKKVAARYPRYPTNKKHN

SEQ ID NO: 3593 - protein, 37 aa, Cucumis sativus
MKIRASIRKICEKCRLIRRRRRIMVICSNPRHKQRQG

SEQ ID NO: 3594 - protein, 222 aa, Bos taurus
MGLFGKTQEKPPKELVNEWSLKIRKEMRVVDRQIRDIQREEEKVKRSVKDAAKKGQKDVCVVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEAAEMEIDRILFEITAGALGKAPSKVTDALPEPEPLGAMAASEDEEEEEEALEAMQSRLATLRS

SEQ ID NO: 3595 - protein, 152 aa, Bos taurus
MAKSKNHTTHNQSRKWHRNGIKKPRSQRYESLKGVDPKFLRNMRFAKKHNKKGLKKMQANNAKAMSARAEAVKALVKPKEIKPKMPTGGSRKLSRLAYIAHPKLGKRARARIAKGLRLCRPKSQAKASTKAKPPAAAAPAAKGAQAPTKAPE

SEQ ID NO: 3596 - protein, 79 aa, Bos taurus
MSEFWHKLGCCVVEKPQPKKKRRRIDRTMIGEPMNFVHLTHIGSGEMGAGDGLAMTGAVQEQMRSKGNRDRPWSNSRGL

SEQ ID NO: 3597 - protein, 133 aa, Bos taurus
MNYMPGTASLIEDIDKKHLVLLRDGRTLIGFLRSIDQFANLVLHQTVERIHVGKKYGDIPRGIFVVRGENVVLLGEIDLEKESDTPLQQVSIEEILEEQRVEQQTKLEAEKLKVQALKDRGLSIPRADTLEEY

SEQ ID NO: 3598 - protein, 567 aa, Bos taurus
MHGRLKVKTSEEQAEAKRLEREQKLKLYQAATQTVFQKRQAGELDESVLELTSQILGANPDFATLWNCRREVLQQLEVQKSPEELATLVKAELGFLESCLRVNPKSYGTWHHRCWLLSRLPEPNWARELELCARFLEVDERNFHCWDYRRFVAAQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGSGMETLLLMVDESPLAVEWRTPEGRNRPSHIWLCDLPATSLNDQLPQHTFRVIWTAGDAQKECVLLKGRQEGWCRDSATDEQLFRCELSVEKSTVLQSELESCKELQELEPENKWCLLTIILLMRALDPLQYEKETLQYFQTLKAVDPMRAAYLDDLRSKFLLENSVLKMEYAEVRVLHLGHKDLTVLCHLEQLLLVTHLDLSHNRLRALPPALAALRCLEVLQANDNAIESLDGVTNLPRLQELILCNNRLQQPAVLQPLTSCPRLTLLNLQGNPLCQAEGSSEHLAELLPSVSSILT

SEQ ID NO: 3599 - protein, 529 aa, Gallus gallus
MSSNLGKEKDCKEKDPKVPSSKEREKESKASGGFGKESKEKEPKTKGKDAKDGKKDSSSTQPGVAFSVDNTIKRPNPATGTRKKSSNAEVIKELNKCREENSMRLDLAKRSIHMLPSAVKELTQLTELYLYSNKLQSLPAEVGCLVNLVTLALSENSLTSLPDSLDNLKKLRMLDLRHNKLREIPSVVYRLTSLATLYLRFNRITTVEKDIKTLSKLTMLSIRENKIKQLPAEIGELCNLITLDVAHNQLEHLPEEIGSCTQITNLDLQHNELLDLPETIGNLSSLSRLGLRYNRLSAIPKSLAKCSELDELNLENNNISTLPEGLLSSLVKLTSLTLARNCFQSYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGIGNLRKLRELDLEENKLESLPNEIAYLKDLQKLVLTNNQLTTLPRGIGHLTNLTHLGLGENLLTHLPEEIGKILFFFFFNVSFLFV

SEQ ID NO: 3600 - protein, 239 aa, Lactobacillus acidophilus
MKVIVTENKIQGSAKAFEIFEKGIKNGAKVLGLATGSTPEILYQNWVKSDLNCDDLTSINLDEYVGLTPDNPQSYHYFMQKHLFDKKTFKKTYIPDGMTKDVPAYCKEYDQIIKDNPIDIQLLGIGQNGHIAFNEPGTPFDIGTHEVKLTENTIKANARFFDNEDEVPKSAICMGTANIMDSKKIVLMAFGEKKAKAIKEMIEGPITEEVPASILQKHPDVTVIVDTYAAQELDDKYKN

SEQ ID NO: 3601 - protein, 61 aa, Lactobacillus acidophilus
MAKDYVTGKKTTFGNKRSHSLNPTRRAWKPNLQKVRILVDGKPKRVWVSTKALKSGKVTRV

SEQ ID NO: 3602 - protein, 157 aa, Lactobacillus acidophilus
MAKVESFTLDHTKVKAPYVRLITVEEGPKGDKISNYDLRLVQPNENAIPTGGLHTIEHLLASLLRDRLDGVIDCSPFGCRTGFHLIVWGEHSTTEVAKALKSSLEEIRDTITWEDVPGTTIKTCGNYRDHSLFTAKEWCRDILEKGISDDPFERNVI

SEQ ID NO: 3603 - protein, 353 aa, Lactobacillus acidophilus
MSIIELKNVDVDFPQKKGKLVKAVNSVSLSIEKGDIYGIVGFSGAGKSTLVRTINLLQKPSAGDIEVDGTQFVKDGKQVISNKELQLKRRNIGMIFQGFNLLNETTVLENVAFALKHEKLSDDELEKKSLELLELVDLKEKANFYPSELSGGQKQRVAIARALANNPDILISDEATSALDPQNTQQILDLLKRLNKQFNLTVILITHEMDAVKKIATKVAVMEHGQVIEKGSLRQVFLHPKQELTKKFVGGSLEAISTLNSLHLDKLSKNESIYQLVYSVNNVAKSIIIELYKEIGVEVSMLYGNVELLNDEPIGTLVVLIKGDQEKQKQAKEFLQKQDVTLTRLDEKGNIYD

SEQ ID NO: 3604 - protein, 103 aa, Lactobacillus acidophilus
MAAQVNGDDNDRQITLIDDQGNEELYEVLFTFHSDDYDKSYVLLYPAAVGDDEDIEVQAFSYDADDTGDVTSSDLHEIESDDEWNMVQGVLNTFLDDDRLSGK

SEQ ID NO: 3605 - protein, 73 aa, Lactobacillus acidophilus
MAKDDVIEVEGKVVDTLPNAMFKVELENGATILAHVSGKIRMHYIRILPGDRVTVELSPYDLTKGRITYRFIK

SEQ ID NO: 3606 - protein, 77 aa, Lactobacillus acidophilus
MFVKTGDKVKVIAGKDKGKEGTVLSVNVKKNRVVVKGVNKIKKHQKPSQTNANGGVVESEGSIHASNVKVISKKEDK

SEQ ID NO: 3607 - protein, 184 aa, Lactobacillus acidophilus
MGLDKFKDKNRDELSMIEVARAILEDNGKRMAFADIVNAVQKYLNKSDEEIRERLPQFYTDMNTDGEFISMGENVWALRSWFPYESVDEEVNHPEDEEEDDSRKHHKKVNAFLASATGDDDIIDYDNDDPEDDDLDAATDDSDDDYSDDDSDYDEDNDDADDVLPDGIEGQLSQLNDEDDDEDD

SEQ ID NO: 3608 - protein, 158 aa, Lactobacillus reuteri
MAKVESFTLDHTKVKAPYVRLITVEEGAKGDKISNYDLRLVQPNENAIPTAGLHTIEHLLAGLLRDRLDGVIDCSPFGCRTGFHLITWGEHSTTEVAKALKSSLEEIAYKTKWEDVQGTTIESCGNYRDHSLFSAKEWSKKILDEGISDKPFERHVVD

SEQ ID NO: 3609 - protein, 114 aa, Gallus gallus
MAKSLRSKWKRKMRAEKRKKNAPKELERLKSILRTGADVVMEEVKEVATVLPAKEALEKQDDCKMDVDNKRNKKTLLDQHGQYPIWMNSRQRKKLKAQRLKGKKKSKLPKGLAW

SEQ ID NO: 3610 - protein, 301 aa, Gallus gallus
MEDATEMSGGAEEFAEGSKINASKNQQDDGKMFIGGLSWDTSKKDLTEYLSRFGEVVDCTIKTDPVTGRSRGFGFVLFKDAASVEKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGKSNASGGRGGGRGRGRGQGQNWNQGFNNYYDQGYGNYNSAYSDQSYSGYGGYDYSGYNYPNYGYGPGYTDYSGQQSTYGKASRGGGNHQNNYQPY

SEQ ID NO: 3611 - protein, 98 aa, Gallus gallus
MPKRKSPEGAEGKDAAKVTKQEPTRRSARLSAKPAPPKPEPKPRKTTKKEPGTKANKGAKGKKDEKQEAAKEGTTPSENGENKAEEAQKTESVGDKNE

SEQ ID NO: 3612 - protein, 110 aa, Gallus gallus
MAHSAPLGLLEQGCPIQVEHDRKRRQFTVRLNGCHDRAVLLYEYVGKRIVDLQHTEVPDAYRGRGIAKHLAKAALDFVVEEDLKAHLTCWYIQKYVKENPLPQYLEHLQP

SEQ ID NO: 3613 - protein, 78 aa, Gallus gallus
MSDFWHKLGCCVVEKPQPKKRRRRIDRSMIGEPMNFVHLTHIGSGDMAAGEGLPMTGAVQEMRSKGGRERQWSSSRVL

SEQ ID NO: 3614 - protein, 599 aa, Gallus gallus; identical to SEQ ID NO: 721

SEQ ID NO: 3615 - protein, 125 aa, Ovis aries [sequence omitted]

SEQ ID NO: 3616 - protein, 73 aa, Saccharomyces cerevisiae
  source: /note="strain ATCC 204508 / S288c"
MIEVVVNDRLGKKVRVKCLAEDSVGDFKKVLSLQIGTQPNKIVLQKGGSVLKDHISLEDYEVHDQTNLELYYL

SEQ ID NO: 3617 - protein, 131 aa, Gallus gallus
MPRPKPRSPRRRGRPPPAAPPPPPARPRARRYRPGQRALREIRRYQSSTALLLRRQPFARVVREICLLFTRGVDYRWQAMALLALQEAAEAFLVHLLEDAYLCSLHARRVTLYPKDLQLARRLRGLQGEGF

SEQ ID NO: 3618 - protein, 282 aa, Lactobacillus johnsonii
MKKLLEGKTPANEIKENLIEEIKKLKSDGINPTLCVIEVGDDPASKIYLRVKRNLAKKVGIKEIGLHFPANTSQAELLEKIEDLNQDPSINGIMVQLPVPPQIDPRAIFETIAPEKDADGFSPLNLGRLWEGQSDVIPATVRSILTLIDYYGIEMAGKNTVIIGRSVIVGKPLAAVLVERDATVTIAHSKTKNLSELTKNADVIISDVGKAHLVTEDMVKEGAVIIDVGMNRENGKLMGDVDFDMVAPKAKAITPVPGGVGPLTVASLMKQAVILTRKQHGR

SEQ ID NO: 3619 - protein, 349 aa, Lactobacillus johnsonii
MAAQIDLKNITVQFGQNKAVNDVSLEINKGDIYGVIGFSGAGKSTLVRTINLLQYPSAGSVEVNGTVLFKDNKLQISKKQLQEKRRKIGMIFQNFNLLNEETVIENVAFALQHSRLSDQELEKKSLHLLELVGLKDKADFYPAQLSGGQQQRVAIARALANDPDILISDEATSALDPKTTNQILDLLYDLNKKLGLTVVLITHEMDAVKRVANKIVVMEKGKVIEKGELREVFLHPQKQLTRQFVGGALQAQHILNTYNFDKLAENAELYQLVYSINDVTKSVVADLDVSLNTKASILYGNVEVLSGEPIGTLAILLNLNELKQKEAIKFLESKNVVVTKLDKGVLTND

SEQ ID NO: 3620 - protein, 250 aa, Lactobacillus johnsonii
MARELCEVQGLIFKRKKYKEADVLTKIMTKDHGIFTIDVRGALRPKSRLGAATLNFSYGKYIVNTNWKGISTLRTFKDVKQLDQLYLDLTKNAYSSYVLDLLDHAFVEYKDIGSFYDLIIKALLKINSGEDAAIITQMVQLKLLNAYGVAPQLDRCLICGKVQGKFDYSLELGGIICSDHFNSVSQRMHLDPKVVALIRTLALVDIDRLGKIKINPQLKKDSGKVIDRMYVNYLDLNLKTKKFLDELALF

SEQ ID NO: 3621 - protein, 180 aa, Lactobacillus johnsonii
MGLDDFQGQNKDELSMIEVARAILQDSGKRMAFADIVNAVQNFLGKSDEEIRERLPQFYTDMNTDGEFISMGHNVWALRSWFPYESVDEEVNHPEDEEDVPRKKHHKKVNAFIGDSDDDDIIDYDSDDPEDEDLDVDEEDTNEDDYSDDDLDDADDNELDDGIEGQLSELHQDDLDDDDE

SEQ ID NO: 3622 - protein, 195 aa, Oryza sativa
  source: /note="subsp. japonica"
MAAESIDAELRLGLPGSGGGDGVAAKKRRSASSTVKSEASGTACCGGAGARDVEDGASPASKVQVVGWPPVGSYRRSTFQSSSSSTAAAAKGKGGGETDQGRKNKGGGLYVKVSMDGAPYLRKVDLRMYGGYRELRDALDALFGCFSADASASAAHFAVAYEDKDGDLMLAGDVPWDMFISSCKKLRIMRGSEAR

SEQ ID NO: 3623 - protein, 88 aa, Pinus koraiensis
MIKNLSISSSLIPDKQRGSVESQVFFLTNRVLRLTQHLQLHGRDYSSQRGLWLILSKRKQLLVYLSKRDKLRYDDLIGQLSIRRLKTR

SEQ ID NO: 3624 - protein, 98 aa, Lactobacillus plantarum
MSQNQDRKDNDVITLVDDEGNETLFNILFTFDSEDFGHSYILLYPADAAADDEVDIQAYIFNPEDGDNGELQLIESDDEWDMVEQVLNTFLADDGGMQ

SEQ ID NO: 3625 - protein, 141 aa, Lactobacillus plantarum
MFFGEFEHALDAKGRLIIPAKFRELLGTSFVITRGMDGCIFGYPAERWATLQAQLDDLPLTRKDARAFVRFFYAAAAECELDKQGRVMIPATLRQYAKLEKQCVIVGVSDRFEIWGAEHWQQFETETAANFDDLAENLIDF

SEQ ID NO: 3626 - protein, 115 aa, Lactobacillus plantarum
MEIEKNYRINSLFEFYEPLLTNKQKAYIQLYYADDYSLGEIAAEFSVSRQAVYDNIKRTEKILEGYEAKLHLYHDFVERNHEVDAISDYIKQNYHGDTQLIKMIQQLVNLEADSE

SEQ ID NO: 3627 - protein, 61 aa, Lactobacillus plantarum
MAKDYVTGKRTHFGNTRSHALNHSRRSWKANLQKVRILVDGKPKKVWVSARTLKSGKVTRV

SEQ ID NO: 3628 - protein, 298 aa, Lactobacillus plantarum
MKKWLIALAGVLLTFTLAGCGSKTVASTSGGKITESQYYSSMKGTSSGKQVLQQMILNKVLEKDYGSKVSTKQVTKQYNTYKSQYGSSFSTVLSQNGLTTKTFKEQLRSNLLLKEAVKDKVKITDKALKKQWKSYEPKVTVQHILVAKSATADKVLDALKKDSSQANFTKLAKKYSTDTTTKNDGGKLSAFDNTNTSYSSKFLTAAFKLKNGEYTTSAVKTSNGYEIIRMIKNPGKGKMSDHTADLKKQIWDNDMSDSTVLQNVVSKVLKGGNVSIKDNDLKDILSSYLSTSSSSSSN

SEQ ID NO: 3629 - protein, 60 aa, Lactobacillus plantarum
MAQLKITLVRSAAHRLPKQRKIVKELGLGRINSSVVKPDDAATRGQIFHIAHLVDVEIIK

SEQ ID NO: 3630 - protein, 199 aa, Lactobacillus plantarum
MELKQFDGQKKSELSLIEVAHAILSQHGDVMAFADLTNAVQSYLGKSDEEIRERLSQFYTDLNIDGSFISLGDNMWGLRAWYPFESIDEAVIHTDDDEDEDRPKRKKVNAFLADAGDDDDVIDYDDDDPEDDDNYDDDDDQDDDTDDSASSKYDELAGVDDTDDDVADETLPDGIEGQLSELNDDDDDDDYDDEDDESK

SEQ ID NO: 3631 - protein, 447 aa, Oryza sativa; identical to SEQ ID NO: 766
  source: /note="subsp. japonica"

SEQ ID NO: 3632 - protein, 145 aa, Equus caballus
MTSRALLLLASALLGTPGLTFSGLNPESYDLATAHLSDGEQFCQGLTQEDLQGDLLTERERQGIACWSCRKILQKLEDLVGEQPNEATINEAASRVCRNLGLLRGACKKIMRTCLRLISRDILAGKKPQEVCVDIKLCKHKAGLI

SEQ ID NO: 3633 - protein, 295 aa, Glycine max
MEFWGVEVKVGQTVTVDPMDPVDSYIHISQVALGEAKKDKPNEPVVLYLKVGEQKIVLGTLSRDGIPHLSLDLVLDSDSELSHTSKSASVFFCGYKVLTGNDNASDFSDSSEEDEELALEGQDNGKPELKAEGAKVTKPSKSIPKIGAPAKAADPKKDEDDDSDDESDDDLAGEDESGSSDEMDDDSNSEEESDGDDEETPAKKVDQGKKRPNESAAKTPISAKKAKTATPEKTDGKKSVHVATPHPSKKGGKTPNSTKGQTPNSAGQLSCASCKKSFTNEAGLQQHKKAKHGGQ

SEQ ID NO: 3634 - protein, 745 aa, Bos taurus; identical to SEQ ID NO: 720

SEQ ID NO: 3635 - protein, 49 aa, Saccharomyces cerevisiae
  source: /note="strain ATCC 204508 / S288c"
MCDWKGRDNCPAPARKTSCVSRAALHSNVRWKWCEKSTLDRASNCWRGT

SEQ ID NO: 3636 - protein, 39 aa, Saccharomyces cerevisiae
  source: /note="strain ATCC 204508 / S288c"
MKVLDDWFSRKFSKAVHGNNHGTISLSTLSYIRVHKLVK

SEQ ID NO: 3637 - protein, 311 aa, Coturnix japonica
MAGELSIGAELPTSPLAMEYVNDFDLMKFDVKKEPLGRNDRSGRHCTRLQPAGSVSSTPISTPCSSVPSSPSFSPTEQKTHLEDLYWMANSYQQMNPEALNLTPEDAVEALIGSHQVSQQLQGFESFRAHHHHHHHHQHHHHQYPAVTHEDLAGSGHPHHHHHHHHHASPTPSTSSSSSQQLQTSHQQHPPSSSVEDRFSDDQLVSMSVRELNRHLRGFTKDEVIRLKQKRRTLKNRGYAQSCRYKRVQQKHHLENEKTQLIQQVEQLKQEVTRLARERDAYKLKCEKLASNGFREAGSTSDNPSSPEFFM

SEQ ID NO: 3638 - protein, 311 aa, Gallus gallus
MAGELSIGAELPTSPLAMEYVNDFDLMKFDVKKEPLGRNDRSGRHCTRLQPAGSVSSTPISTPCSSVPSSPSFSPTEQKTHLEDLYWMANSYQQMNPEALNLTPEDAVEALIGSHQVSQQLQGFESFRAHHHHHHHHHQHHHQYPAVTHEDLAGSGHPHHHHHHHHQASPTPSTSSSSSQQLQTSHQQHPPSSSVEDRFSDDQLVSMSVRELNRHLRGFTKDEVIRLKQKRRTLKNRGYAQSCRYKRVQQKHHLENEKTQLIQQVEQLKQEVTRLARERDAYKLKCEKLASNGFREAGSTSDNPSSPEFFM

SEQ ID NO: 3639 - protein, 144 aa, Bos taurus
MAASKVKQDMPPVGGYGPIDYKRNLPRRGLSGYSMFAVGIGALLFGYWSMMKWNRERRRLQIEDFEARIALMPLLQAEKDRRVLQMLRENLEEEATVMKDVPGWKVGESVFHTTRWVTPMMGELYGLRASEEVLSATYGFIWYT

SEQ ID NO: 3640 - protein, 303 aa, Zea mays
MEFWGLEVKPGSTVKCEPGHGFILHVSQAALGESKKSDSALMYVKVDDKKLAIGTLSIDKYPQIQFDLVFNKEFELSHTSKTTSVFFSGYKVEQPIEGDEMDLDSEDEEEELNIPVIKENGKADGKEEQKNQEKAVAATASKSSLGLEKKSKDDSDDSDEDESDDSDEDDSDDSDEGEGLSPDEGDDDSSDEDDTSDDDEEETPTPKKPEAGKKRGAENALKTPLSDKKAKVATPPAQKTGGKKGATHVATPHPAKGKTPANNDKLTEKSPKSGGSVPCKSCSKTFNSEMALQAHSKAKHGAK

SEQ ID NO: 3641 - protein, 1474 aa, Ovis aries; identical to SEQ ID NO: 756

SEQ ID NO: 3642 - protein, 1462 aa, Ovis aries; identical to SEQ ID NO: 757

SEQ ID NO: 3643 - protein, 111 aa, Bifidobacterium adolescentis
  source: /note="strain ATCC 15703 / DSM 20083 / NCTC 11814 / E194a"
MAAKIKSGDLVKVIRGKDRGKEGTVKQVLKDDRLIVEGVQIVKKHVRATQQGQQAGIVAVEAPIHRSNVMVIDPETKQPTRVRIVEKEEARDGKVKTVRVRVAKKSGKELA

SEQ ID NO: 3644 - protein, 37 aa, Bifidobacterium adolescentis
  source: /note="strain ATCC 15703 / DSM 20083 / NCTC 11814 / E194a"
MKVSPSVKRICENCRVIRRHGRVMVICVNPRHKQRQG

SEQ ID NO: 3645 - protein, 125 aa, Bifidobacterium adolescentis
  source: /note="strain ATCC 15703 / DSM 20083 / NCTC 11814 / E194a"
MARLAGVDIPNEKRIEIALTYIFGVGRTRAKETLAATGINPDIRVKDLTDEQLITLRDYLEGNYKIEGDLRREIDADIRRKIQINCYQGQRHRKGLPVRGQRTKTNARTRKGPKRTVAGKKKATK

SEQ ID NO: 3646 - protein, 86 aa, Bifidobacterium adolescentis
  source: /note="strain ATCC 15703 / DSM 20083 / NCTC 11814 / E194a"
MANIKSQKKRVLTNEKAHKRNVAVKSSLKTAVRATREAIAAGDKAAAEAAYKVAAQKLDKAAGAGVIHKNQAANRKSGLAVAINAL

SEQ ID NO: 3647 - protein, 64 aa, Bifidobacterium adolescentis
  source: /note="strain ATCC 15703 / DSM 20083 / NCTC 11814 / E194a"
MPKMKTNSAASKRVRVTGSGKLMHAGSAMRHNLEHKSARKRRELKADGVLATSQSKNMKKLLGR

SEQ ID NO: 3648 - protein, 64 aa, Bos taurus
MSGREGGKKKPLKQPKKQAKEMDEEDKAFKQKQKEEQKKLEELKAKAAGKGPLATGGIKKSGKK

SEQ ID NO: 3649 - protein, 344 aa, Aspergillus niger; identical to SEQ ID NO: 420
  source: /note="strain CBS 513.88 / FGSC A1513"

SEQ ID NO: 3650 - protein, 427 aa, Aspergillus niger; identical to SEQ ID NO: 409
  source: /note="strain CBS 513.88 / FGSC A1513"

SEQ ID NO: 3651 - protein, 149 aa, Oryza sativa
  source: /note="subsp. indica"
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 3652 - protein, 65 aa, Oryza sativa
  source: /note="subsp. indica"
MSDKCGHCDCADKSQCVKKGTSYGVVIVDAEKSHFEMAEEVGYEENDGKCKCTTGCSCAGCNCGK

SEQ ID NO: 3653 - protein, 200 aa, Oryza sativa
  source: /note="subsp. indica"
MASHQDQASYRAGETKAHTEEKAGQVMGASKDKASEAKDRASEAAGHAAGKGQDTKEATKEKAQAAKERASETAQAAKDKTSGTAQAARDKAAESKDQTGGFLGEKTEQAKQKAAETAGAAKQKTAETAQYTKDSAIAGKDKTGSVLQQASEQVKSTVVGAKDAVMSTLGMTEDKAGTDDGANKDTSATAAATETTARDH

SEQ ID NO: 3654 - protein, 65 aa, Oryza sativa
  source: /note="subsp. japonica"
MSDKCGNCDCADKSQCVKKGTSYGVVIVDAEKSHFEMAEEVGYEENDGKCKCTTGCSCAGCNCGK

SEQ ID NO: 3655 - protein, 216 aa, Phaseolus vulgaris
MGQKINPLGFRLGTTQSHDSIWFAQPTKYSENIQEDKKIRDWIKNYIQKNIRISSGVEGIGEIKIQKRIDLIQVIIYMGFPKLLIEGKPHKIEEFQTNMHKKLNCVNKKLNIAIVKITNAYKHPNILAEFIAGQLKNRVSFRKAMKKAIELTEQAGTKGVQVQIAGRIDGKEIARVEWIREGRVPLQTIRAKIEYCCYTVRTIYGILGIKVWIFSK

SEQ ID NO: 3656 - protein, 53 aa, Phaseolus vulgaris
MAVPKKRTSISKKIIRNTLWKKKGYFTALKAFSLAQSLFTGNSKSFFCNKYKR

SEQ ID NO: 3657 - protein, 90 aa, Phaseolus vulgaris
MVKNSFIPVLSQEKKGKNPGLVEFQIFQFTNRIRRLTSHFELHPKDYSSQTGLRKILGKRQRLLSYLSKKDGIQYKKLINQFDIRQSQIR

SEQ ID NO: 3658 - protein, 400 aa, Bos taurus
MLEAMAEPSPEDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFPRLQAPDSATLLEKMKLKDSLFDIDGPKMASPLSPTSLTHASRPPAALTPVPLSQGDLSQPPRKKDRKNRKLGPGGATGFGVLRRPRPAPGDGEKRSRIKKSKKRKLKKAERGDRLPPPGPPRAPPSDTDSEEEEEEEEEEEEMAAMVGGEAPAPVLPTPEAPRPPATVHPEGAPPTDGESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 3659 - protein, 96 aa, Lactobacillus reuteri
  source: /note="strain DSM 20016"
MASEKYYIYVLYCADNSFYCGFTNNVKRRFHTHQTYQGAKYTRVKKRHPLKLIYSEEFESKHDALSAEYYFKHQTRRQKEKFLLDHGVDLLKLRRN

SEQ ID NO: 3660 - protein, 65 aa, Lactobacillus reuteri
  source: /note="strain DSM 20016"
MPKMKSNRAAAKRFKRTANGGFKSGNSFTSHRFHGKTKKQRRQLRGLSMMDKTNVKRYKKLLPFK

SEQ ID NO: 3661 - protein, 39 aa, Lactobacillus reuteri
  source: /note="strain DSM 20016"
MKVRPSVKKMCEHCKIVKRNGRVMVICSANPKHKQRQGK

SEQ ID NO: 3662 - protein, 92 aa, Lactobacillus reuteri
  source: /note="strain DSM 20016"
MGRSLKKGPFADASLLKKVKEQEGSEKKTVIKTWSRRSTIFPSFIGYTFAVYDGRKHVPVYVQEDMVGHKLGEFVPTRTFHGHASDDKKTGK

SEQ ID NO: 3663 - protein, 116 aa, Bos taurus
MAAAAPGSGAAREEEGTGGDAATPQPPAPTSAPGARLSRLPLARVKALVKADPDVTLAGQEAIFILARAAELFVETIAKDAYCCAQQGKRKTLQRRDLDNAIEAVDEFAFLEGTLD

SEQ ID NO: 3664 - protein, 142 aa, Bos taurus
MSKNVVIAEQEKNNEHCPEDINDKLSESTDDDGEDTSDEDKEEDSNPNKDTHAPLELMTEFLRAEMGHDYHLAKKLCQMILIYEPENPEAKEFFSLIEEMLLMEKAQNLEEDDDESEEDNSESEGESTEDPSEESSDECEDG

SEQ ID NO: 3665 - protein, 90 aa, Ipomoea purpurea
MVKNLFISVISQEETKENRGSVEFQIFNFTNKIQRLTSHLKLHKKDYLSQKGLRKILGKRQRLLAYLSKKNKVRYKELIEKLDIRETKTH

SEQ ID NO: 3666 - protein, 569 aa, Solanum lycopersicum; identical to SEQ ID NO: 837

SEQ ID NO: 3667 - protein, 92 aa, Carica papaya
MIKNSFISFQEKKKENSGSVEFQVFSFTNKIRRLTSHLELHRKDYLSQRGLRKILGKRQRLLSYLSKKNRVRYKELINQLDIRESKKISFLN

SEQ ID NO: 3668 - protein, 121 aa, Lactobacillus reuteri
  source: /note="strain JCM 1112"
MAFDKDAIIASLKEASISDLNDLVKAIEEEFDVSAAAPVAVAGAAGGDAAAKDSFTVELTEPGSAKVKVIKAVKDITGLGLKDAKDLVDGAPSAIKEDVKEDEANDIKEKLEAAGATVTLK

SEQ ID NO: 3669 - protein, 70 aa, Lactobacillus reuteri
  source: /note="strain JCM 1112"
MTFKVYYQADKTKRPVRENTQSLYIEADSEAEALLMVEHNTDYNIEFVEQLDEKALAYEKQNPNFKLTTF

SEQ ID NO: 3670 - protein, 89 aa, Lactobacillus reuteri
  source: /note="strain JCM 1112"
MAKKSKIAKLHHQEALVKKYAEKRKELKAKGDYIGLSKLPRNSSAVRLHNRDRYDGRPHAYMRKFGMSRIKFRELAHKGQIPGVRKASW

SEQ ID NO: 3671 - protein, 123 aa, Lactobacillus reuteri
  source: /note="strain JCM 1112"
MVVNIYDTANELSRQLRETQEYQGLQKAFEALKADGDTFDTFKKFQQAQADAQHKQMTGQQPTDDEIKNIQNLAKEVSGKKVVQDLMNQERQVDSMLQQLNKTITSPIQDLYSEVMPKMPGQE

SEQ ID NO: 3672 - protein, 66 aa, Welwitschia mirabilis
MPAKTGPRVVVFLECFHCTQKGAQKKFPGVFRYITKKNRHNKSTPLELKKFCPFCLKHTIHKERKK

SEQ ID NO: 3673 - protein, 73 aa, Welwitschia mirabilis
MTNMTNQISNNTGSVQSQVRFLTDRIQKLSRHLGTHKKDFSCQRSIRKLLIKRKRLLLYLYKKDKTGYNQVKS

SEQ ID NO: 3674 - protein, 111 aa, Bifidobacterium longum
  source: /note="strain DJO10A"
MAAKIKSGDLVKVIRGKDRGKEGTVKQVLSNDRLIVEGVQIVKKHVRATQQGQQAGIVSTEAPIHRSNVMVIDPETKQPTRVGITVKEEARDGKVKTVRVRVAKKSGKELA

SEQ ID NO: 3675 - protein, 64 aa, Bifidobacterium longum
  source: /note="strain DJO10A"
MPKMKTNSAASKRAKITGTGKVKHVGSAMRHNLEHKSARKRRELSADDVLRGGQAKKLHQLLQK

SEQ ID NO: 3676 - protein, 67 aa, Bifidobacterium longum
  source: /note="strain DJO10A"
MPQQFEQPQAQQAATQEDDALATTQAAAQTESADQADVLDDILDDIESTLETNAEEYVNSFVQKGGE

SEQ ID NO: 3677 - protein, 87 aa, Bifidobacterium longum
  source: /note="strain DJO10A"
MKTFESLFAELSEKAQTRPEGSLTVDELDKGTHFIGKKIIEEAGETWMAAEYEGADRTAEEMSQLLYHVQVMMIKHGLTLEDVYKHL

SEQ ID NO: 3678 - protein, 86 aa, Bifidobacterium longum
  source: /note="strain DJO10A"
MANIKSQKKRVLTNEKAHLRNVAVKSGLKTAIRATREAIAAGDKAAAEAAYKVAAQKLDKAAGAGVIHKNQAANRKSGLAVAINAL

SEQ ID NO: 3679 - protein, 106 aa, Saccharomyces cerevisiae
  source: /note="strain RM11-1a"
MSKLGPLARSVKWTLSVGVIGSVFYLYRYSNNGYFYDHDATWLKQDHQVQDLVDRKEVVPGETRNRKLVVTDDGTAWSRTMGESIKDIWNEQIRNSVDWIYSWGKN

SEQ ID NO: 3680 - protein, 99 aa, Lactobacillus casei
  source: /note="strain BL23"
MGNMQGMMKQMQKMQKEMQAAQRELYATEFEGKSASDMVTVKFTGEKIMKDIQIKPEAIDPDDPDMLQDLIIEAVNQAMGTIDKETQDKMGKYTRGLPM

SEQ ID NO: 3681 - protein, 114 aa, Lactobacillus casei
  source: /note="strain BL23"
MANVYDTANQMAADIKTTQEFQDLKKAFDLLKLDTVAYGLFQQFQQKQYEMQQKSMQGQDFTDDEVKSLQELGDKMRDIQPIQNLMAKEQGLSQMMDELNKIISQPIIDVYQGK

SEQ ID NO: 3682 - protein, 86 aa, Bifidobacterium longum
  source: /note="subsp. infantis"
  source: /note="strain ATCC 15697 / DSM 20088 / JCM 1222 / NCTC 11817 / S12"
MANIKSQKKRVLTNEKAHLRNVAVKSGLKTAIRATREAIAAGDKAAAEAAYKVAAQKLDKAAGAGVIHRNQAANRKSGLAVAINAL

SEQ ID NO: 3683 - protein, 67 aa, Bifidobacterium longum
  source: /note="subsp. infantis"
  source: /note="strain ATCC 15697 / DSM 20088 / JCM 1222 / NCTC 11817 / S12"
MPQQFEQPQAQQAVTQEDDALATTQAATQTESTDQADVLDDILDDIESTLETNAEEYVNSFVQKGGE

SEQ ID NO: 3684 - protein, 98 aa, Bifidobacterium animalis
  source: /note="subsp. lactis"
  source: /note="strain AD011"
MPTFTREEIVHLGDLARIALTDEEITRMQSELNVIADAIDSVQEVATADVEPTANPVPLEAYLRPDVPATPLTQAEALSGAPVAEDGMFVAPRILGEE

SEQ ID NO: 3685 - protein, 63 aa, Bifidobacterium animalis
  source: /note="subsp. lactis"
  source: /note="strain AD011"
MPKMKTKTAAAKRVRLTATGKVMHAGSGMRHNLEHKSARKRRALKRDDVLQTAQAKKMKGLLG

SEQ ID NO: 3686 - protein, 86 aa, Bifidobacterium animalis
  source: /note="subsp. lactis"
  source: /note="strain AD011"
MANIKSQKKRVRTNEKAHQRNVAVKSALKTYIRRTREAIASGDKAAAEAAFAIAGRKLDQAAGKGVIAKNQAANRKSSLALQINAM

SEQ ID NO: 3687 - protein, 44 aa, Bifidobacterium animalis
  source: /note="subsp. lactis"
  source: /note="strain AD011"
MKRTFQPNNRRRHMKSGFRVRMRTRAGRALINRRRAKGRKSLSA

SEQ ID NO: 3688 - protein, 111 aa, Bifidobacterium animalis
  source: /note="subsp. lactis"
  source: /note="strain AD011"
MVAKIKSGDLVKVIRGKDRGKEGTVKRVLKDDRLIVEGVQIVKKHVRATQQGQQAGIVSVEAPIHRSNVMVIDPETKQPTRVGVVIKEEARDGKVKTVRVRVAKKSGKELA

SEQ ID NO: 3689 - protein, 538 aa, Bacillus megaterium; identical to SEQ ID NO: 665
  source: /note="strain DSM 319"

SEQ ID NO: 3690 - protein, 291 aa, Bacillus amyloliquefaciens; identical to SEQ ID NO: 662
  source: /note="strain ATCC 23350 / DSM 7 / BCRC 11601 / NBRC 15535 / NRRL B-14393"

SEQ ID NO: 3691 - protein, 256 aa, Bacillus amyloliquefaciens; identical to SEQ ID NO: 668
  source: /note="strain ATCC 23350 / DSM 7 / BCRC 11601 / NBRC 15535 / NRRL B-14393"

SEQ ID NO: 3692 - protein, 265 aa, Bacillus amyloliquefaciens; identical to SEQ ID NO: 656
  source: /note="strain ATCC 23350 / DSM 7 / BCRC 11601 / NBRC 15535 / NRRL B-14393"

SEQ ID NO: 3693 - protein, 550 aa, Saccharomyces cerevisiae; identical to SEQ ID NO: 820
  source: /note="strain FostersB"
  MOD_RES (455)..(455): Any amino acid

SEQ ID NO: 3694 - protein, 894 aa, Glycine max; identical to SEQ ID NO: 801

SEQ ID NO: 3695 - protein, 284 aa, Arthrospira platensis C1; identical to SEQ ID NO: 607

SEQ ID NO: 3696 - protein, 267 aa, Glycine max; identical to SEQ ID NO: 830

SEQ ID NO: 3697 - protein, 125 aa, Saccharomyces cerevisiae
  source: /note="strain ATCC 204508 / S288c"
MEKDEEDEESEEAEEELLVLESDEKLNDVNDMEAMLVDELVCDTRDLLDVDEVREDESALEEETILDDKMELEELTLLTEERAVDTAEEFEDDDCTKNCARIVDMHDSIKSNKRKLFLVVKDNIL

SEQ ID NO: 3698 - protein, 25 aa, Glycine max
MGGVGKTKRMRRLKRKRRKMRQRSK

SEQ ID NO: 3699 - protein, 91 aa, Bos taurus
MGLEDEQRMLTGSGDPKEEEEEEEELVDPLTTVREQCEQLEKCVKARERLELCDERVSSRSQTEEDCTEELLDFLHARDHCVAHKLFNSLK

SEQ ID NO: 3700 - protein, 96 aa, Brassica napus
ATYKVKFITPEGEQEVECDDDVYVLDAAEEAGIDLPYSCRAGSCSSCAGKVVSGFVDQSDESFLDDDQIAEGFVLTCAAYPTSDVTIETHKEEELV

SEQ ID NO: 3701 - protein, 49 aa, Bos taurus
GQFLEDPSVLTKEKLKSELVANNVTLPAGEQRKDVYVELYLQHLTALKR

SEQ ID NO: 3702 - protein, 49 aa, Bos taurus
PEFLEDPSVLTKEKLKSELVANNVTLPAGEQRKDVYVELYLQSLTALKR

SEQ ID NO: 3703 - protein, 49 aa, Bos taurus
PEFLEDPSVLTKEKLKSELVANNVTLPAGEQRKEVYVELYLQHLTALKR

SEQ ID NO: 3704 - protein, 51 aa, Bos taurus
MARYRCCLTHSGSRCRRRRRRRCRRRRRRFGRRRRRRVCCRRYTVIRCTRQ

SEQ ID NO: 3705 - protein, 106 aa, Saccharomyces cerevisiae
  source: /note="strain ATCC 204508 / S288c"
MVNVPKTRKTYCKGKTCRKHTQHKVTQYKAGKASLFAQGKRRYDRKQSGFGGQTKPVFHKKAKTTKKVVLRLECVKCKTRAQLTLKRCKHFELGGEKKQKGQALQF

SEQ ID NO: 3706 - protein, 79 aa, Bos taurus
MSAKKSPEELKGIFEKYAAKEGDPNQLSKEELKLLLQTEFPSLLKGPSTLDELFEELDKNGDGEVSFEEFQVLVKKISQ

SEQ ID NO: 3707 - protein, 88 aa, Bos taurus
ESSFPATFVPLPADSEGGEDEDLQCVCLKTTSGINPRHISSLEVIGAGTHCPSPQLLATKKTGRKICLDQQRPLYKKILKKLLDGDES

SEQ ID NO: 3708 - protein, 149 aa, Triticum aestivum
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQDGFISAAELRHVMTNLGEKLTDEEVDEMIREADVDGDGQINYEEFVKVMMAK

SEQ ID NO: 3709 - protein, 93 aa, Triticum aestivum
MASGQQERSQLDRKAREGETVVPGGTGGKSLEAQENLAEGRSRGGQTRREQMGEEGYSQMGRKGGLSTNDESGGDRAAREGIDIDESKFKTKS

SEQ ID NO: 3710 - protein, 51 aa, Saccharomyces cerevisiae
  source: /note="strain ATCC 204508 / S288c"
MAAQKSFRIKQKMAKAKKQNRPLPQWIRLRTNNTIRYNAKRRNWRRTKMNI

SEQ ID NO: 3711 - protein, 59 aa, Saccharomyces cerevisiae
  source: /note="strain ATCC 204508 / S288c"
MAKSKNHTAHNQTRKAHRNGIKKPKTYKYPSLKGVDPKFRRNHKHALHGTAKALAAAKK

SEQ ID NO: 3712 - protein, 161 aa, Coturnix japonica
MDDIYKAAVEQLTEEQKNEFKAAFDIFVLGAEDGCISTKELGKVMRMLGQNPTPEELQEMIDEVDEDGSGTVDFDQFLVMMVRCMKDDSKGKTEEELSDLFRMFDKNADGYIDLEELKIMLQATGETITEDDIEELMKDGNKNNDGRIDYDEFLQFMKGVE

SEQ ID NO: 3713 - protein, 177 aa, Saccharomyces cerevisiae
  source: /note="strain ATCC 204508 / S288c"
MTSNSDGSSTSPVEKPITGDVETNEPTKPIRRLSTPSPEQDQEGDFDEEDDDDKFSVSTSTPTPTITKTKDSSDTSTVTRRKQPIRYIENKTRRHVTFSKRRHGIMKKAYELSVLTGANILLLILANSGLVYTFTTPKLEPVVREDEGKSLIRACINASDTPDATDTSPAQEQSPAN

SEQ ID NO: 3714 - protein, 559 aa, Saccharomyces cerevisiae
  source: /note="strain ATCC 204508 / S288c"
MMEEFSYDHDFNTHFATDLDYLQHDQQQQQQQQHDQQHNQQQQPQPQPIQTQNLEHDHDQHTNDMSASSNASDSGPQRPKRTRAKGEALDVLKRKFEINPTPSLVERKKISDLIGMPEKNVRIWFQNRRAKLRKKQHGSNKDTIPSSQSRDIANDYDRGSTDNNLVTTTSTSSIFHDEDLTFFDRIPLNSNNNYYFFDICSITVGSWNRMKSGALQRRNFQSIKELRNLSPIKINNIMSNATDLMVLISKKNSEINYFFSAMANNTKILFRIFFPLSSVTNCSLTLETDDDIINSNNTSDKNNSNTNNDDDNDDNSNEDNDNSSEDKRNAKDNFGELKLTVTRSPTFAVYFLNNAPDEDPNLNNQWSICDDFSEGRQVNDAFVGGSNIPHTLKGLQKSLRFMNSLILDYKSSNEILPTINTAIPTAAVPQQNIAPPFLNTNSSATDSNPNTNLEDSLFFDHDLLSSSITNTNNGQGSNNGRQASKDDTLNLLDTTVNSNNNHNANNEENHLAQEHLSNDADIVANPNDHLLSLPTDSELPNTPDFLKNTNELTDEHRWI

SEQ ID NO: 3715 - protein, 165 aa, Gossypium hirsutum
MQSMKDAAASAKAGMEKAKASMQEKVDQMKTRDPNEKEMARERKEERQEDAELRKQEARHHNATAGHVGGGGIGGTGYTTAGYNIGDTGGYGGTGGHDNRGYPTAGSGYDTGRQDDLSSMGFGGDTEGAYGTTGNQDFPNAASNNAGTRRNTRGGTQDDPYYRSY

SEQ ID NO: 3716 - protein, 49 aa, Capra hircus
YLDPGLGAPAPYPDPLEPKREVCELNPDCDELADHIGFQEAYRRFYGIA

SEQ ID NO: 3717 - protein, 200 aa, Oryza sativa
  source: /note="subsp. japonica"
MASHQDQASYRAGETKAHTEEKAGQVMGASKDKASEAKDRASEAAGHAAGKGQDTKEATKEKAQAAKERASETAQAAKDKTSSTSQAARDKAAESKDQTGGFLGEKTEQAKQKAAETAGAAKQKTAETAQYTKDSAIAGKDKTGSVLQQASEQVKSTVVGAKDAVMSTLGMTEDEAGTDDGANKDTSATAAATETTARDH

SEQ ID NO: 3718 - protein, 33 aa, Saccharomyces cerevisiae
  source: /note="strain ATCC 204508 / S288c"
MATKGNLKRQTKYFSTIAYTETRGEATLRANYQ

SEQ ID NO: 3719 - protein, 46 aa, Saccharomyces cerevisiae
  source: /note="strain ATCC 204508 / S288c"
MRSHFDTEYLGDLARKFKCTISWNYDIRFIVQYKVQRVILITHLNV

SEQ ID NO: 3720 - protein, 67 aa, Bifidobacterium longum
MPQQFEQPQAQQAATQEDDALATTQAAAQTESTDQADVLDDILDDIESALETNAEEYVNSFVQKGGE

SEQ ID NO: 3721 - protein, 833 aa, Saccharomyces cerevisiae
  source: /note="strain ATCC 204508 / S288c"
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNSNNNAGSPIRPYKQRYLLKNRANSSTSSENPSLTPFDIESNNDRKISEIPFDDEEEEETDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRAKK

SEQ ID NO: 3722 - protein, 37 aa, Spinacia oleracea
MKIRASVRPICEKCRLIRRRGRIIVICSNPKHKQRQG

SEQ ID NO: 3723 - protein, 731 aa, Saccharomyces cerevisiae
  source: /note="strain ATCC 204508 / S288c"
MDKLVVNYYEYKHPIINKDLAIGAHGGKKFPTLGAWYDVINEYEFQTRCPIILKNSHRNKHFTFACHLKNCPFKVLLSYAGNAASSETSSPSANNNTNPPGTPDHIHHHSNNMNNEDNDNNNGSNNKVSNDSKLDFVTDDLEYHLANTHPDDTNDKVESRSNEVNGNNDDDADANNIFKQQGVTIKNDTEDDSINKASIDRGLDDESGPTHGNDSGNHRHNEEDDVHTQMTKNYSDVVNDEDINVAIANAVANVDSQSNNKHDGKDDDATNNNDGQDNNTNNDHNNNSNINNNNVGSHGISSHSPSSIRDTSMNLDVFNSATDDIPGPFVVTKIEPYHSHPLEDNLSLGKFILTKIPKILQNDLKFDQILESSYNNSNHTVSKFKVSHYVEESGLLDILMQRYGLTAEDFEKRLLSQIARRITTYKARFVLKKKKMGEYNDLQPSSSSNNNNNNDGELSGTNLRSNSIDYAKHQEISSAGTSSNTTKNVNNNKNDSNDDNNGNNNNDASNLMESVLDKTSSHRYQPKKMPSVNKWSKPDQITHSDVSMVGLDESNDGGNENVHPTLAEVDAQEARETAQLAIDKINSYKRSIDDKNGDGHNNSSRNVVDENLINDMDSEDAHKSKRQHLSDITLEERNEDDKLPHEVAEQLRLLSSHLKEVENLHQNNDDDVDDVMVDVDVESQYNKNTTHHNNHHSQPHHDEEDVAGLIGKADDEEDLSDENIQPELRGQ

SEQ ID NO: 3724 - protein, 124 aa, Saccharomyces cerevisiae
  source: /note="strain ATCC 204508 / S288c"
MIRRAPTTLQLSHDDVTSLIDDLNEQKLKQQLNIEKTKYFQGKNGGSLHSNTDFQDTSQNIEDNNNDNDNDIDEDDDMSSYNDKAASVAHTRVLNSLHLSTDSNTAHETSNANDNHNPFYIREE

SEQ ID NO: 3725 - protein, 98 aa, Raphanus sativus
SAVYKVKLIGPDGQENEFDVPDDQYILDAAEEAGVDLPYSCRAGACSTCAGKIEKGQVDQSDGSFLEDHHFEKGYVLTCVAYPQSDLVIHTHKEEELF

SEQ ID NO: 3726 - protein, 98 aa, Raphanus sativus
SAVYKVKLIGPEGEENEFEVQDDQFILDAAEEAGVDLPYSCRAGACSTCAGQIVKGQVDQSEGSFLEDDHFEKGFVLTCVAYPQSDCVIHTHKETELF

SEQ ID NO: 3727 - protein, 50 aa, Equus caballus
MARYRCCRSQSQSRCRRRRRRRCRRRRRRSVRQRRVCCRRYTVLRCRRRR

SEQ ID NO: 3728 - protein, 92 aa, Daucus carota
MASQQEKKELDARARQGETVVPGGTGGKSLEAQQHLAEGRSKGGQTRKEQLGGEGYHEMGRKGGLSNNDMSGGERAEQEGIDIDESKFRTKK

SEQ ID NO: 3729 - protein, 166 aa, Sus scrofa
MSYTTYFLAFQLCVTLCFSGSYCQAPFFKEITILKDYFNASTSDVPNGGPLFLEILKNWKEESDKKIIQSQIVSFYFKFFEIFKDNQAIQRSMDVIKQDMFQRFLNGSSGKLNDFEKLIKIPVDNLQIQRKAISELIKVMNDLSPRSNLRKRKRSQTMFQGQRASK

SEQ ID NO: 3730 - protein, 269 aa, Rhizomucor miehei; identical to SEQ ID NO: 428

SEQ ID NO: 3731 - protein, 92 aa, Sus scrofa
MVRCRVRSPSESPQQGSGQQRENERQDQDQELRPEDVPVYGRTHRGRYHYRHRSHTRRRRSCRRRRRRACRHRRHRRGCRRIRRRRRCRRRL

SEQ ID NO: 3732 - protein, 115 aa, Bos taurus
MVRCHVKSPTESPPGQQGSGQQGETEHPDQARELRPEDIPVYGRTHRGRYHYRHRSHTRRRPYRRRRRRACRHRRRRRGAAGPPCAPIPGTPQASRQGSGCRRMRRRRRRCGRQL

SEQ ID NO: 3733 - protein, 97 aa, Daucus carota
AEVKLGADDGALVFSPSSFSVAKGEGISFKNNAGFPHNIVFDEDEVPAGVDVSKISQEDYLDGAGESFTVTLTEKGTYKFYCEPHAGAGMKGEVTVT

SEQ ID NO: 3734 - protein, 54 aa, Ovis aries
STSRKLKSQGTRRGKNRTPHKGVKRGCSKRKYRKSSLKSRKRCDDANRNFRSHL

SEQ ID NO: 3735 - protein, 94 aa, Triticum aestivum
MASGQEKGRSELDSLAREGQTVVPGGTGGKSYEAQEKLAEGRSRGGQTRKEQMGEEGYSEMGRKGGLSTNDESGGERAAREGIDIDESKFKTKS

SEQ ID NO: 3736 - protein, 42 aa, Oncorhynchus mykiss
MSDKPNLEEVASFDKTKLKKTETQEKNPLPTKETIEQEKQAS

SEQ ID NO: 3737 - protein, 132 aa, Bos taurus
MDTKTQSLPNTHAQPHSNSRPQSHACHHCSCSQHCQSRSRSRSCRSRSSSRRPRSHRSPTGRQGQSPGPSPPLRRHRHTMHSHQCPSRPVTHSCSHSKNRKNLEGKVIKRKQVKRSKQVYKRKRQSSGRKYN

SEQ ID NO: 3738 - protein, 214 aa, Octopus vulgaris
MPSYTLHYFNHRGRARSAVCCSQLLVSSTMTADRVFRMGQHEKQDAMSHDANVGIGQQNPNSPEYAMARYLAREFGFHGRNNMEMARVDFISDCFYDILDDYMRMYQDGNCRMMFQRSRDMSSSSEKRMRFQETCRRILPFMERTLEMYNGGSQYFMGDQMTMADMMCYCALENPLMEEPSMLSSYPKLMALRNRVMNHSKMSSYLQRRCRTDF

SEQ ID NO: 3739 - protein, 119 aa, Gallus gallus
MSKGCQTQGPLSELEKAIDVIIDVFHQYSRREGDKDTLTRKELKLLIEKQLANYLKHVKNQVSIDQIFKDLDNNKDQQLSFGEVMLLIIRVTVATHEHLHFCEDHQQQHQHQHQHQHNH

SEQ ID NO: 3740 - protein, 57 aa, Spinacia oleracea
MAVPKKRTSIYKKRIRKNIWKKKGYWAALKAFSLAKSLSTGNSKSFFVRKISNQTLE

SEQ ID NO: 3741 - protein, 148 aa, Gallus gallus
MATSDIQVKELEKRASGQAFELILGPRSKEAAPEFPLSPPKKKDLSLEEIQKKLEAAEERRKSHEAEVLKQLAEKREHEKEVLQKAIEENNNFSKMAEEKLTHKMEANKENREAQMAAKLERLREKDKHIEEVRKNKEGKDPGEAETN

SEQ ID NO: 3742 - protein, 672 aa, Saccharomyces cerevisiae
  source: /note="strain ATCC 204508 / S288c"
MKQEQSHEGDSYSTEFINLFGKDTATHPSSNNGANNNGMGSTNSLDQFVATASSSSSLVTSSENRRPLIGDVTNRGNTNLYDHAVTPEILLEQLAYVDNFIPSLDNEFSNVDWNVNTTHNNANNNGADTFSSINANPFDLDEQLAIELSAFADDSFIFPDEDKPSNNNNNSNNGNDDHSNHDVLHEDPSTNNRQRNPHFLTQRRNTFLTSQYDQSKSRFSSKNKRNGNNGETNNFGDNMQNNHPFEPNFMGSPSQFPADATNMTSIDHGGFTNVDITSTENNTTGDNGVDALSNLLHRTTHTPNRSSPLSNVTSAQNSSSQQRKHSESKVDSNSDNNSSNKAPNITVPDYSIIPTSVLVTLLPRVNVPNGAYNSLISAGFDNDQIDAIAAIMAYHHQKKIRENNSNNNKNINTNDSQEAPILKNINELLSVLIPPSPAETRGPTTLSTSPSFNEHGVVAEASFLSSILELGIKHPKSNNIHNQRQPSRNDHKISRESDGNNGNDNVHHNNAVIKSSTTRGDEIAKIRSEPTLNASSSDHKENSLKRSHSGDLKNKKVPVDRKYSDNEDDEYDDADLHGFEKKQLIKKELGDDDEDLLIQSKKSHQKKKLKEKELESSIHELTEIAASLQKRIHTLETENKLLKNLVLSSGETEGIKKAESLKKQIFEKVQKE

SEQ ID NO: 3743 - protein, 94 aa, Saccharomyces cerevisiae
  source: /note="strain ATCC 204508 / S288c"
MDRSLQVYICMYPYLDGSKQYRFDELISFYRPCPKSLDNIKSHYRQIHHQIRRRTHQHHQIRRRTHQHHHRSNCSRQRQCLVRHSCGRQMRVLA

SEQ ID NO: 3744 - protein, 114 aa, Solanum lycopersicum
MAEEKHQHHHHLFHHKNKEDEGGPVDYEKEVKHHSHLEKIGELGAVAAGALALHEKHKAKKDPEHAHKHKIEEEIMAVAAVGAGGFAFHEHHQKKDAKKEKKEVEGGHHHHHHY

SEQ ID NO: 3745 - protein, 108 aa, Solanum lycopersicum
MAEEKQHHRLFHHKNREEEGGPVDHKKKVKHHSHLQKIGELGAVAAGAYALHEKHKAKKDPENAHKHKIKQEIAAVAAVGAGGFAFHEHHQKKEAKKEKKAAEKGRHH

SEQ ID NO: 3746 - protein, 366 aa, Saccharomyces cerevisiae
  source: /note="strain ATCC 204508 / S288c"
MNYMAYDYDPQHSLETSFNNLAFHPHQQSQQQALYESGERNDARPGLMNTLGQASKMNNSMLPQGSSASPLTGQHSLNSTTNFNMPPSMNTYNYQNVPQASMRNTLNHNNIMNGATANDYWLDPMNNMTNNKDTNGNPNDSMSSMSNMTAKTSINSTAFKNSFVPFNHVTALSMNNVNSNEMNSNKDDRMEALEVELQIKESQIESLENEIQRLKKIFNEGLNYKQNEHKYEKENCHIPQTFELPASLEVIFRKLSSSLHAKEKELAETKENLESILTALALNPTNSVTKYGRYDAESIAHKMVVRLENLTNENKEMAKMLAYGRSKETQIELQLAKKENLELREKIASLEAHLASKESSKEDVAN

SEQ ID NO: 3747 - protein, 211 aa, Saccharomyces cerevisiae
  source: /note="strain ATCC 204508 / S288c"
MLRRSKNSSTNTNADTKKRQSMHLGSKSSLISLTSEFGHGHSKTKQKKEEGTAPSQFLSPTNKRSTSSQSKLKRSSLLLDETLLKDYHSAMRHMQTNAAKEEKLRMAPSPTQSTRSESDASLSSTKSSISSIFSQDNDYSIHDLLYEDIEEMDKTDAFKINNTIAIDDSKALFVFCSNDSSSRTASIETLHESNLDNLDMGSSRRTSLDFF

SEQ ID NO: 3748 - protein, 255 aa, Saccharomyces cerevisiae
  source: /note="strain ATCC 204508 / S288c"
MGKFEQKERERISTFSFPTTGSQSSTSIKSLGSPLYGRFSSLSSTESQFDSSKQPHEYEKSFYFEESQGEALFNKLKTYSFPGDKDGVKTRRNSSICPRKPNAVSPLRVESNELSSHSHSRSLSHELTKPSGRRKSYHRKSHAISFSRSCKPNFIDGYDSNSSIGVNSRKTSLASSFLDKEYHSSPDTSYTHQMSPKNTIMNTNEQLRRNASGRFGSLKEFAEKNQINIEGKIFAHKVETGDILQPLIDLDIDNK

SEQ ID NO: 3749 - protein, 74 aa, Saccharomyces cerevisiae
  source: /note="strain ATCC 204508 / S288c"
MNKYLFDHKIWSTPYYFYCEEDCHRLFLSFIEGRTFEKPTSNAEENVQETEAGESFTLNPGEDFQNCFPRQRIL

SEQ ID NO: 3750 - protein, 112 aa, Saccharomyces cerevisiae
  source: /note="strain ATCC 204508 / S288c"
MDLRSALEKTNIIKSYKLHFLIRYTTSRFEVKEPFLAYLHMARQKDKLLPKCITPPNKKADPFTNDVSSYFTHTHTHTPCSPSLVYTYVNTTEKSPSKSPKHKNILPFNFTK

SEQ ID NO: 3751 - protein, 70 aa, Pinus thunbergii
MAVPKKRTSRSKKKIRKNVRKGKAYRAAIKAFSLAKSISTGHSKSFYCIVNDDSSGSSESKLTAIDLDDP

SEQ ID NO: 3752 - protein, 93 aa, Triticum aestivum
MASGQQERSELDRMAREGETVVPGGTGGKSLEAQEHLADGRSRGGETRKEQLGEEGYREMGRKGGLSTMEESGGERAAREGIEIDESKFKTKS

SEQ ID NO: 3753 - protein, 151 aa, Pisum sativum
MGRLHSKGKGISSSALPYRRTAPSWLKISSQDVDETICKFAKKGLTPSQIGVILRDSHGIAQVKSVTGSKILRILKAHGLAPEIPEDLYHLIKKAVSIRKHLERFRKDKDSKFRLILVESRIHRLARYYKKTKKLPPVWKYESTTASTLVA

SEQ ID NO: 3754 - protein, 91 aa, Zea mays
MASGQESRKELDRKAREGETVVPGGTGGKSVEAQEHLAEGRSRGGQTRREQLGQQGYSEMGKKGGLSTTDESGGERAAREGVTIDESKFTK

SEQ ID NO: 3755 - protein, 95 aa, Oryza sativa
  source: /note="subsp. japonica"
MASGQQQQGRSELDRMAREGQTVVPGGTGGKSLEAQENLAEGRSRGGQTRKEQMGEEGYREMGRKGGLSTGDESGGERAAREGIDIDESKYKTKS

SEQ ID NO: 3756 - protein, 190 aa, Ovis aries
METQMASPSLGRCSLWLLLLGLLLPSASAQALSYREAVLRAVGQLNEKSSEVNLYRLLELDPPPKDAEDQGARKPVSFRVKETVCPRMSQQPPEQCDFKENGLVKQCVGTVSLDTSNDEFDLNCNELQSVRRLRPRRPRLPRPRPRPRPRPRSLPLPRPQPRRIPRPILLPWRPPRPIPRPQPQPIPRWL

SEQ ID NO: 3757 - protein, 51 aa, Oryza sativa
  source: /note="subsp. japonica"
MPSHKTFRIKKKLAKKMRQNRPIPYWIRMRTDNTIRYNAKRRHWRRTKLGF

SEQ ID NO: 3758 - protein, 417 aa, Bos taurus; identical to SEQ ID NO: 107

SEQ ID NO: 3759 - protein, 116 aa, Saccharomyces cerevisiae
  source: /note="strain ATCC 204508 / S288c"
MLLTPAKTTRTEDSANSTDDSSKSSNSFMRAIVSSLMVKPITSLTNTVTCRQSSHHNSSPSKITRYDLIKAAAENDLKRSKSQGREKSRRNSNRRNNEEIFVANTASEIQRTKSSI

SEQ ID NO: 3760 - protein, 386 aa, Saccharomyces cerevisiae; identical to SEQ ID NO: 850
  source: /note="strain ATCC 204508 / S288c"

SEQ ID NO: 3761 - protein, 86 aa, Saccharomyces cerevisiae
  source: /note="strain ATCC 204508 / S288c"
MPPRSIEEWFYYKLLSSPGFHRFVRKVYRKVNGIKEDPFTDQSTAFQYLYKPTPRQKFKALRLLFWDEMRSTFGFRRRLGDRFKKD

SEQ ID NO: 3762 - protein, 79 aa, Lactobacillus johnsonii
MFVKTGDKVKVIAGKDKGKEGTVLSVNAKTNRIVVKGVNKIKKHEKPSQTNANGGVVEKEGSIHASNVKVIAKKEDNNK

SEQ ID NO: 3763 - protein, 149 aa, Anas platyrhynchos [sequence omitted]

SEQ ID NO: 3764 - protein, 44 aa, Bos taurus
MSDKPDMAEIEKFDKSKLKKTETQEKNPLPSKETIEQEKQAGES

SEQ ID NO: 3765 - protein, 71 aa, Bos taurus
MASNNTASIAQARKLVEQLKMEANIDRIKVSKAAADLMAYCEAHAKEDPLLTPVPASENPFREKKFFCAIL

SEQ ID NO: 3766 - protein, 44 aa, Equus caballus
MADKPDMGEIASFDKAKLKKTETQEKNTLPTKETIEQEKRSEIS

SEQ ID NO: 3767 - protein, 51 aa, Capra hircus
MARYRCCLTHSRSRCRRRRRRRCRRRRRRFGRRRRRRVCCRRYTVVRCTRQ

SEQ ID NO: 3768 - protein, 616 aa, Aspergillus niger; identical to SEQ ID NO: 363

SEQ ID NO: 3769 - protein, 92 aa, Bos taurus
MTKLEDHLEGIINIFHQYSVRVGHFDTLNKRELKQLITKELPKTLQNTKDQPTIDKIFQDLDADKDGAVSFEEFVVLVSRVLKTAHIDIHKE

SEQ ID NO: 3770 - protein, 68 aa, Saccharomyces cerevisiae
  source: /note="strain ATCC 204508 / S288c"
MGAAYHFMGKAIPPHQLAIGTLGLLGLLVVPNPFKSAKPKTVDIKTDNKDEEKFIENYLKKHSEKQDA

SEQ ID NO: 3771 - protein, 49 aa, Equus caballus
YLDHWLGAPAPYPDPLEPRREVCELNPDCDELADHIGFQEAYRRFYGPV

SEQ ID NO: 3772 - protein, 49 aa, Bison priscus
YLDHGLGAPAPYPDPLEPKREVCELNPDCDELADHIGFQEAYRRFYGPV

SEQ ID NO: 3773 - protein, 76 aa, Equus caballus
QAEESCLQNLASRYLQTVTDYGKDLVEKALAPELQAQAKAYFEKTQEQLTPLVKKIGNDLLNFFSHFIELKTQPAT

SEQ ID NO: 3774 - protein, 134 aa, Bos taurus
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEEEEESILDTVLKYLPGPLQDMFKK

SEQ ID NO: 3775 - protein, 49 aa, Lama guanicoe
YLDHGLGAPAPYVDPLEPKREVCELNPDCDELADQMGFQEAYRRFYGTT

SEQ ID NO: 3776 - protein, 291 aa, Bacillus subtilis; identical to SEQ ID NO: 405
  source: /note="strain 168"

SEQ ID NO: 3777 - protein, 88 aa, Solanum lycopersicum
MQTGKDAASAAKAGMEKTKANVQEKAERMTTRDPLKKEMATEKKEDRVAAAEMGKRDAKAQHAAEKQGAATTGTGTTGYGATGNHTTF

SEQ ID NO: 3778 - protein, 175 aa, Saccharomyces cerevisiae
  source: /note="strain ATCC 204508 / S288c"
MNESENSPQHNEVTVPMVEDTSSNADIPMEQIQREDNKNYDKHDNECFDMNGNHNNNSDNLQFDSVPSSATKDLKNIKSVTNQNVKIEESSSTNSVIEESSEPKISKLENVNLAATVGGSQTRKYLNTNVTPHLLAGMRLIAVQQPEDPLRVLGEYLIEQSNILKSGEKESNASK

SEQ ID NO: 3779 - protein, 46 aa, Lactobacillus casei
  source: /note="strain ATCC 334"
MTTKRTFQPKKRHRERVHGFMKRMSTKNGRKVLARRRAKGRKVLSA

SEQ ID NO: 3780 - protein, 89 aa, Lactobacillus casei
  source: /note="strain ATCC 334"
MAKKSKIAKAKRQEKLVQQYAVKRAALKAKGDYIGLSKLPRDSSPVRLHHRDVLDGRPHAYMRKFGMSRLNFRELAHKGQIPGVRKASW

SEQ ID NO: 3781 - protein, 49 aa, Lactobacillus casei
  source: /note="strain ATCC 334"
MTAKKVALACSVCGQRNYFVPENPKRTERLTLKKFCKHCGRVTVHQETK

SEQ ID NO: 3782 - protein, 114 aa, Lactobacillus casei
  source: /note="strain ATCC 334"
MANVYDTANQMAADIKTTQEFQDLKKAFDLLKLDTVAYGLFQQFQQKQYEMQQKSMQGQDFTDDEVKSLQELGDKMRGIQPIQNLMAKEQGLSQMMDELNKIISQPIIDVYQGK

SEQ ID NO: 3783 - protein, 66 aa, Lactobacillus casei
  source: /note="strain ATCC 334"
MPKFKTHRASAKRFKKTASGALKRGHAYTSHRFHGKTKKQRRQLRKSALVSHSDMKRIRQMLSQMK

SEQ ID NO: 3784 - protein, 113 aa, Lactobacillus casei
  source: /note="strain ATCC 334"
MEIEKNYRMNSLFEFYGPLLTDKQHAYLALYYGDDYSLGEIATEFNVSRQAVYDNIRRTEASLEEYEKKLHLFANYQAQNEAVDTLVSYARTHYPDDKALSTLLERVADQTAK

SEQ ID NO: 3785 - protein, 89 aa, Lactobacillus casei
  source: /note="strain ATCC 334"
MATKTYYFYVLLCADGSFYGGFTDDVKARVATHNAGKGAKYTAQRLPVRLLYHQAFADKHDALSAEWHFKHQTRHRKEVFLEDHQVEWR

SEQ ID NO: 3786 - protein, 80 aa, Lactobacillus casei
  source: /note="strain ATCC 334"
MHRTFYEYLMTLRNPNDHSEIAEFAKNAFLDQSFPKQEKDYHRLSDYLELNGNYLPSMAVFDETYRAYEASESTGGDSYQ

SEQ ID NO: 3787 - protein, 109 aa, Lactobacillus gasseri
  source: /note="strain ATCC 33323 / DSM 20243"
MSRRPNFGGMGMGNMQGLIKQAKKMQQQMEAEQANLATQEFVGKSADDMVVATFSGDRQLKDLKIDKEAIDPDDPDMLQDLVIDAVNKGIKAVDDATQASMGKYTKGLM

SEQ ID NO: 3788 - protein, 79 aa, Lactobacillus gasseri
  source: /note="strain ATCC 33323 / DSM 20243"
MFVKTGDKVKVIAGKDKGKEGTVLSVNAKTNRIVVKGVNKIKKHEKPSQANANGGVVEKEGSIHASNVKVIAKKEDNNK

SEQ ID NO: 3789 - protein, 95 aa, Lactobacillus gasseri
  source: /note="strain ATCC 33323 / DSM 20243"
MSRSIKKGPFADASLLKKIEAQEGSEKKQVIKTWSRRSTIFPSFVGFTIAVYDGRKHVPVYITEDMVGHKLGEFVPTRTFRGHKVADKATTTVGK

SEQ ID NO: 3790 - protein, 79 aa, Lactobacillus delbrueckii
  source: /note="subsp. bulgaricus"
  source: /note="strain ATCC BAA-365"
MFVKTGDKVKVIAGSEKGKEGTVLSVNVKKNRVVVKGVNMIKKATKASASNANGGVVETEGSIHASNVKVIAKAESNKD

SEQ ID NO: 3791 - protein, 83 aa, Lactobacillus delbrueckii
  source: /note="subsp. bulgaricus"
  source: /note="strain ATCC BAA-365"
MKKGIHPDYQEVCFMDAATGFKFVAGSTLKSSETVEFEGNTYPLIRVEISSDSHPFYTGKQKFAAADGRIERFNKKYGFNKKN

SEQ ID NO: 3792 - protein, 383 aa, Saccharomyces cerevisiae
  source: /note="strain ATCC 204508 / S288c"
MTSASITNTGNETMNLPQMRSIWLDEDEEAEKLYGLQAQQFMGSDDEENLGITFINSDKPVLSNKKNIELPPLSPNSHPSCHHRRSNSNSAKSKESSSSSSSANKTNHKKVFLKLNLLKKKLLGAQPDIRGKGISTPFDFQHISHADTRNGFQDEQLQEPSSLSTEIKDDYTSSSSKRDSKSLNKAFVTERIPANRESKLISRSHENKTSRLSVARSISVTSSNYSKNTQGNNHSINGRVVSTSTMATSIFEYSPNASPKQFKNKSHALGHRYTNSTDSSESSLDFLKNYNFPTLLEDKPILDFLPRSQRSSAYRSLLETPNSNKDSAKAFFPSRQSPLPKRRNSIATPSPQSKFSYSDSPVNHRKSFDDVLYSFNQLEPLQT

SEQ ID NO: 3793 - protein, 115 aa, Solanum lycopersicum
MEEEKHHHHHLFHHKDKAEEGPVDYEKEIKHHKHLEQIGKLGTVAAGAYALHEKHEAKKDPEHAHKHKIEEEIAAAAAVGAGGFAFHEHHEKKDAKKEEKKKLRGDTTISSKLLF

SEQ ID NO: 3794 - protein, 105 aa, Saccharomyces cerevisiae
  source: /note="strain ATCC 204508 / S288c"
MLMPKEDRNKIHQYLFQEGVVVAKKDFNQAKHEEIDTKNLYVIKALQSLTSKGYVKTQFSWQYYYYTLTEEGVEYLREYLNLPEHIVPGTYIQERNPTQRPQRRY

SEQ ID NO: 3795 - protein, 52 aa, Citrus sinensis
MAVPKKRTSILKKRIRKNLWKKGGYWAALKAFSLAKSLATGNSKSFFCTTNK

SEQ ID NO: 3796 - protein, 55 aa, Daucus carota
MAVPKKRTSISKKRIRKNIWKGKGSWAALKALSLGKSLSTGNSKSFFVRQKKNKS

SEQ ID NO: 3797 - protein, 194 aa, Bos taurus
MTENSTSTPAAKPKRAKASKKSTDHPKYSDMIVAAIQAEKNRAGSSRQSIQKYIKSHYKVGENADSQIKLSIKRLVTTGVLKQTKGVGASGSFRLAKSDEPKRSVAFKKTKKEVKKVATPKKAAKPKKAASKAPSKKPKATPVKKAKKKPAATPKKTKKPKTVKAKPVKASKPKKTKPVKPKAKSSAKRTGKKK

SEQ ID NO: 3798 - protein, 149 aa, Oryza sativa
  source: /note="subsp. japonica"
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVEEMIREADVDGDGQINYDEFVKVMMAK

SEQ ID NO: 3799 - protein, 86 aa, Sus scrofa
MSKQPVSNVRAIQANINIPMGAFRPGAGQPPRKKECTPETEEAVLPTSDEEKKPIPGAKKLPGPAVNLSEIQNIKSELKYVPRAEQ

SEQ ID NO: 3800 - protein, 587 aa, Bos taurus
MDLPGDSSTPGRQRLCRQPHAGALWGAKSPKRPKLQPLGAPSPLEKASRRVLAVVLEDVMAARMVPLEPQEESSTPRHHSNHRDSVRSQPPASPPRQAMWSPQARPPDPLHLCREPLSRIRRPPSTPRRQSRTTPGPDEGPSQKVDQVHQPTLVVMLQDIASSRPRAEGFADEAPNFIIPARRAEPKVMVHQPKPPSRDLPAPSRPSALSANPLASPPPAPDPVLEPPSTPPPSSLLRPRLSPWGLAPLFHSVRSKLESFADIFLTPNKAPRPPPPSPPMKLELKIAISEAGQPGASEGTVTVSPRPPIRQWRAQDQNPSATLTKPSLGRSHSCPDLGPPGPDPCSWPPVPAPSSRPRPRRHTVGGGEMAKAPPPPRPCLRKEVFPLGGVGASPPLVTSCSSTASTSSFSEPAEPRLSSTKRKEPRAPEDQVLPDSETKTIGKVSRFRIRRTPARSQINLTPMGLPRPVRLNKKEFSLEEIYTNKNYQSPTTRRTFETIFEEPRERNGTLIFTSSRKLRRTVEFRDSSLPRSRRPSRGARATAGRTLPPSLAPSPDVEPLLQQRLQELDASLLEEEEEGDQDQPHRT

SEQ ID NO: 3801 - protein, 447 aa, Saccharomyces cerevisiae
  source: /note="strain ATCC 204508 / S288c"
MSSQNLNDNPKNTSSAAEDKKKQTSSLKLAPIPTTSPWKSSSPDSNTVIPVEELRDISKTAKPSKNGSGSIKLTSNTKWTPITPSVIISGSKDTNSKSGKNSKNSKTNKKMKKRGKYNNDINKKDFNGQTNSTSEISNVSNLESKPLDANAKVNIHSSSGATANGNIKRITNNNNSTNGRQSRNYQNRNGKTRYNNNSRHSQAANNAISFPNNYQARPEYIPNASHWLNNNSRNSYKQLSYFRQQQYYNNINYQQQLQTPYYYSMEPIFKSIESIKNQIEFYFSEENLKTDEFLRSKFKKANDGFIPMSLIGKFYRMVNLSLGGDPNLILASMREVLQHKETNHLEIALGSIEGAQKNMADDFNPLENYFIRRENWAEYAMESNFDENDDETEKYNIEKLLGPNDLDNYSYMGYPNFFPSNENGKKSQSYDQGEISRQFEQNLQIND

SEQ ID NO: 3802 - protein, 63 aa, Saccharomyces cerevisiae
  source: /note="strain ATCC 204508 / S288c"
MAKVHGSLARAGKVKSQTPKVEKTEKPKKPKGRAYKRLLYTRRFVNVTLVNGKRRMNPGPSVQ

SEQ ID NO: 3803 - protein, 295 aa, Saccharomyces cerevisiae
  source: /note="strain ATCC 204508 / S288c"
MATFNPQNEMENQARVQEYKVSTGRGGAGNIHKSMSKPSPVLLPLKSNSKTVANNNNNGSNQEKVPRFAIGRGGAGNIFHDPHLTRSAQQLDSNDNINYNDVINDIDDYISPITSDMVDEGGSNPVTNTRSRISATRSHQSLHATTSSPNNNAPIVVGRGGAGNIFFNKKKVASNGGNEEDEIRGGNIEDEDTINANEDNLFVVTSNGNALAAIKSTSKKPKNKLKGKSAPEKFAIGRGGAGNIISPKSSRNTINHNLNDDDEDKFNLKDDNGKEKKKKKKKKSGFFSSLKTMFN

SEQ ID NO: 3804 - protein, 62 aa, Bos taurus
MSERQGAGTTNGKDKPSGENDGQKKVQEEFDIDMDAPETERAAVAIQSQFRKFQKKKAGSQS

SEQ ID NO: 3805 - protein, 37 aa, Populus alba
MKIRASARKICEKCRLIRRRGRILIICSNPRHKQRQG

SEQ ID NO: 3806 - protein, 103 aa, Lactobacillus delbrueckii
  source: /note="subsp. bulgaricus"
  source: /note="strain ATCC 11842 / DSM 20081"
MYAVIKTGGKQYKVAEGESIFVEKLDVQAGEEVVFDQVILVANGDDVKVGTPLVEGAKVVASVDKQGKEKKVVTFKYKPKKHSHSKYGHRQPYTKVTVKSIEA

SEQ ID NO: 3807 - protein, 83 aa, Lactobacillus delbrueckii
  source: /note="subsp. bulgaricus"
  source: /note="strain ATCC 11842 / DSM 20081"
MPQIKSAIKRVKTQAVANERNAAQLSTMRTAVKKFKAAQAAGADNASELYVAAIRELDKAASKGLIHKNKATRDKSRLAKLAK

SEQ ID NO: 3808 - protein, 79 aa, Lactobacillus delbrueckii
  source: /note="subsp. bulgaricus"
  source: /note="strain ATCC 11842 / DSM 20081"
MFVKTGDKVKVIAGSEKGKEGTVLSVNVKENRVVVKGVNMIKKATKASASNANGGVVETEGSIHASNVKVIAKAESNKD

SEQ ID NO: 3809 - protein, 91 aa, Lactobacillus delbrueckii
  source: /note="subsp. bulgaricus"
  source: /note="strain ATCC 11842 / DSM 20081"
MSRSIKKGPFADAHLLKKVDEQQAAEKKQVIKTWSRRSTIFPSFVGLTIAVYDGRKHVPVFVTEDMVGHKLGEFVPTRTFRGHKADDKASK

SEQ ID NO: 3810 - protein, 378 aa, Bos taurus
MASKPEKRVASSVFITLVPPRRDEAVVEEVRRAACEAWPGRPWESAPTKAPGAGSVGKLRSWMPPGRAAAPGPAVPPQLSNGGCSLPPPPLDVDDALPDLDLLPPPPPPPAADLPPPDEEPHSAMGASLISDLEQLHLPPPPPPPQALVEGPPLQPRPSHLKPAEEELPPPPEEPVSFPEREASTDICAFCHKTVSPRELAVEAMKRQYHAQCFTCRVCRRQLAGQSFYQKDGRPLCEPCYQDTLEKCGKCGEVVREHIIRALGQAFHPSCFTCVTCARRIGDESFALDSQNEVYCLDDFYRKFAPVCSICENPIIPRDGKDAFKIECMGRNFHENCYRCEDCRVLLSVEPTDQGCYPLNNRLFCKPCHVKRSAAGCC

SEQ ID NO: 3811 - protein, 98 aa, Bos taurus
MLSRLQELRKEEETLLRLKAALHDQLNRLKVEELALQSMISSRREGEMLPSQPAPEPSHDMLVHVDNEASINQTALELSTRSHVQEEEEEEEEEEEDS

SEQ ID NO: 3812 - protein, 159 aa, Bos taurus
MEKACKEPEEQPQSPPKADEERPSVEPSPEKSSPEEQSSEEVSSEEEFFPDELLPELLPEMLESEERPPQERLSRKDLFEARPPMEQPPCGVGKHKLEEGSFKERLARSRPQFRGDIHGRNLSNEEMIKVAEEMEEMKRVRNKLMVMHWKARRNRPYPI

SEQ ID NO: 3813 - protein, 131 aa, Bos taurus
MLSGGGGDADLANAAARGQVEAVRQLLEAGVDPNRLNRFGRRPIQVMMMGSARVAELLLLHGADPNCADPATLTRPVHDAAREGFLDTLVALHRAGGRLDVRDAWGRLPVDLAEERGHRDVARYLRATAGD

SEQ ID NO: 3814 - protein, 54 aa, Gossypium hirsutum
MAVPKKRTSTSKKRIRKNVWKKKGYWAALKAFSLAKSLSTGNSKSFFVRQINLE

SEQ ID NO: 3815 - protein, 87 aa, Solanum bulbocastanum
MVKNSVISVIFQEEKKGSVEFQVFNFTNKIRRLTSHLELHKKDYLSQRGLKKILGKRQRLLAYLAKKNRVRYKELINQLDIRETKTH

SEQ ID NO: 3816 - protein, 53 aa, Glycine max
MAVPKKRTSISKKRIRNTLWKKKGYFTTLKAFSLAQSIFTGNSKSFFCNKYKR

SEQ ID NO: 3817 - protein, 90 aa, Glycine max
MVKNSIIPVISQEKKEKNPGSVEFQIFKFTDRIRRLTSHFELHRKDYLSQRGLRKILGKRQRLLSYLSKKDRIRYKKLINQFDIRESQIR

SEQ ID NO: 3818 - protein, 216 aa, Glycine max
MGQKINPLGFRLGTTQSHDSIWFAQPTNYSENIQEDKKIRDCIKNYIQKNIRISSGVEGIGQIKIQKRIDLIQVIIYMGFPKLLIEGKSQKIEELQTNMQKKLNCVNRKLNIAIVKVANAYKHPNIIAEFIAGQLKNRVSFRKAMKKAIELTEQAGTKGVQVQIAGRIDGKEIARVEWIREGRVPLQTIRAKIDYCCYTVRTIYGVLGIKVWIFSK

SEQ ID NO: 3819 - protein, 388 aa, Bos taurus
MAEDGLPKIYSHPPAESTKTTTEATIFFGADNTIPKSETTITSEGDHVTSVNDYMLENDFSTTTGNKLIPPKERQKSEDDVESHLEKEFATLMDIKNPMANESITENFLPVKTGNISSTDAISLIDFSTDIAKEDILLDTIDPGDKDVSLTSEVSGTPKESTAAIADTPILPNIMGKSDVSNYSSSVKFKVPADGNAHITDSSVPEAEITPTTERNLTTIPDITALTEEKITEIDLILPENDPNVVPKLTDSDEEKFITVFELTTTAERDKDNPEDALLTDEESTDEVSVWMERDMANEEESHSVLLTAVESRYDFVIPASVTMNLTEDLLTEEDLPENNRMESVTKNTDELSGTTPDLDAFSHKEDNFTTETGVFKLLKEEPDEFLI

SEQ ID NO: 3820 - protein, 62 aa, Saccharomyces cerevisiae
  source: /note="strain ATCC 204508 / S288c"
MDTEEKKKTTASVEHARMLQNEIQQLFAQLRDTNSQIRCDLNEFEQIKESSTTADSTTNSAN

SEQ ID NO: 3821 - protein, 241 aa, Bos taurus
MPIFKCPQKSEPLWKEWDQKAQKNGLRHQVFAVNGDHYVGEWKDNVKHGKGTQVWKKNGAIYEGDWKSGKRDGYGTLSLPDQETGKYKRAYSGWWKGDKKCGYGIQFFGPKEYYEGDWCGNQRSGWGRMYYSNGDIYEGQWRNDKPEGEGMLRLKNGNRYEGNWQRGVKNGSGRFFHLDHGQLFEGFWVDDVAKCGTMIDFGRDEAPQPTQFPIPEVKILDPDGVLEEALAMFKKTKEEGD

SEQ ID NO: 3822 - protein, 196 aa, Bos taurus
MSQSESPGLQEESLHGSWVELHFGSNGNGSSVPDSVSIYKGDMEKILLDAQHESGRSSSKSSHCDSPPRSQTPQDTNRASETDTHSLGEKNSSQSEEDYMERRKEVESILKKNSDWIWDWSSRPENVPPAKEFLLFKHPKRTPTLSMRNTSVMKKGGIFSAEFLKVFLPSLLLSHLLAIGLGIYIGRRLTTSTSTF

SEQ ID NO: 3823 - protein, 88 aa, Bos taurus
MANSDVKPKSISRAKKWSEEIENLYRFQQAGYRDEIEYKQVKQVSMVDRWPETGYVKKLQRRDNTFYYYNKQRECDDKEVHKVKIYAY

SEQ ID NO: 3824 - protein, 66 aa, Bos taurus
MDPPARKEKPKVKEPVSRIEKAKQKSAQQELKQRQRAEIYALNRVMTELEQQQFDEFCKQMQPPGE

SEQ ID NO: 3825 - protein, 93 aa, Bos taurus
MGSRCAKLGTGHGRGHESSMKKLVACVSQDNFSLSSEGEEEEEGEEEEEEEGEEEELPVQGKLLLMEAGQQEEGAEDADSEVQQSPEPKQTRS

SEQ ID NO: 3826 - protein, 125 aa, Bos taurus
MAAAGLAQIPDVDIDSDGVFKYVLIRVYAAPPSGDPAVETKEIVRGYKWAEYHADIYDKVSGEIQKKGYDCECLGGGRISHQSQDRKIHVYGYSMGYGRAQHSVSTEKIKAKYPDYEVTWADDGY

SEQ ID NO: 3827 - protein, 57 aa, Bos taurus
MKPAVDEMFPEGAGPYVDLDEAGGSTGLLMDLAANEKAVHADFFNDFEDLFDDDDIQ

SEQ ID NO: 3828 - protein, 218 aa, Lactuca sativa
MGQKINPIGFRLGTTQGHHSLWFAQPKNYSEGLQEDKKIRTYIQNYVQKNMKTSSGVEGIARIEIQKRIDLIQIIIYMGFPKILIESRPRGIEELQMNLQKEFHSVNRKLNIAITRIEKPYGNPNILAEFIAGQLKNRVSFRKAMKKAIELTEQADTKGIQVQIAGRIDGKEIARVEWIREGRVPLQTIRAKIDYCCYTVRTIYGVLGIKIWIFIDGE

SEQ ID NO: 3829 - protein, 68 aa, Saccharomyces cerevisiae
  source: /note="strain ATCC 204508 / S288c"
MHLCQNGHYYKPHRASAEKVPYLKKKKKNSRNEGKAKKKNEKKKIGTVEFFQQKKKEKKRVLNAVCGL

SEQ ID NO: 3830 - protein, 64 aa, Saccharomyces cerevisiae
  source: /note="strain ATCC 204508 / S288c"
MSSRQGGKMKPLKQKKKQQQDLDPEDIAFKEKQKADAAAKKALMANMKSGKPLVGGGIKKSGKK

SEQ ID NO: 3831 - protein, 68 aa, Saccharomyces cerevisiae
  source: /note="strain ATCC 204508 / S288c"
MAKSVFNFFHFEILEYLNRFVYHSQYFLPYYCSLEVLGKSRKNWTFQYWCLYITTDKKIIKKKDFYHR

SEQ ID NO: 3832 - protein, 140 aa, Sus scrofa
MDVFMKGLSKAKEGVVAAAEKTKQGVAEAAGKTKEGVLYVGSKTKEGVVHGVTTVAEKTKEQVTNVGEAVVTGVTAVAQKTVEGAGSIAAATGFGKKDQLGKNEEGAPQEGILEDMPVDPDNEAYEMPSEEGYQDYEPEA

SEQ ID NO: 3833 - protein, 92 aa, Bos taurus [sequence omitted]

SEQ ID NO: 3834 - protein, 592 aa, Bos taurus
MAPPVKGKRKQSEEGEPLDPPVSPQPDGEPRSRSPVRLEEPPEAGREREEEQEEEQAFLVSLYKFMKERHTPIERVPHLGFKQINLWKIYKAVEKLGAYELVTGRRLWKNVYDELGGSPGSTSAATCTRRHYERLVLPYVRHLKGEDDKPLPPSKPRKQYKMAKEPRGDDGATERPKKVKEEKRVDQLMPAKTKTDAPDPARLPSQETPRDGMEQRGPAAGPSLPFLGASGCPEAYKRLLSSFYCRGTHGIMSPLAKKKLLAQVSKAEALQCQEEGCRHGAGGEPQAPPAAPPLESPQSPGGPAEDSRHRLTPLEGRQAPGGGLWGETQAGPRPSAPVVTGCFHAYPSEVLKPISQRPRDLFPSLKDRVLLGPPAKEEGLPAKEPPLVWGGDAGRPSAFHKGSSRKGSLYPKPKACWVSPMTKVPAESPVPLPTFPSSPGLGHKRSLAEDSSVHGSKKLRAVSPFLKEANAQECGTKPRGPDLAVSCLLGPALPEAYRGTLLRCPLNFAGTLGPLKGQATLPFSPLVIPAFPAHLLATTAPSPMTAGLMHLPPASFDSALCHRLCPASSPWHVPPATAYTAPHFSFHLNTKL

SEQ ID NO: 3835 - protein, 51 aa, Bos taurus [sequence omitted]

SEQ ID NO: 3836 - protein, 140 aa, Bos taurus
MSGSFYFVIVGHHDNPVFEMEFLPAGKAESKDDHRHLNQFIAHAALDLVDENMWLSNNMYLKTVDKFNEWFVSAFVTAGHMRFIMLHDVRQEDGIKNFFTDVYDLYIKFAMNPFYEPNSPIRSSAFDRKVQFLGKKHLLS

SEQ ID NO: 3837 - protein, 57 aa, Acorus calamus
MAVPKKRTSISKKRIRKNFWKKKGYFAAVKAFSLAKSVSTGQSKSFFVRQTSNKSLE

SEQ ID NO: 3838 - protein, 37 aa, Acorus calamus
MKIRASVRKICEKCRLIRRRGRIIVICYNPKHKQRQG

SEQ ID NO: 3839 - protein, 86 aa, Bos taurus
MSKQPVSNVRAIQANINIPMGAFRPGAGQPPRRKECTPEIEEGAPPTSDEEKKPIPGAKKLPGPAVNLSEIQNIKSELKYVPKAEQ

SEQ ID NO: 3840 - protein, 445 aa, Zea mays; identical to SEQ ID NO: 90

SEQ ID NO: 3841 - protein, 134 aa, Cucumis sativus
MGKDTIANIITSIRNADMNRKGMVRIPATNITENIVKILLREGFIENVRKHRESNKDFWVLTLRHRRNRKGPYKTILNLKRISRPGLRIYSNYQKIPRILGGMGIVILSTSRGIMTDREARLQGIGGEILCYIW

SEQ ID NO: 3842 - protein, 90 aa, Cucumis sativus
MVKNSFSSVISQEEKKENGGSVEFQVVSFTNKIRRLTSHLELHKKDYLSQRGLRKILGKRQRLLSYLSKKNKMRYKELINQLDIRESKTQ

SEQ ID NO: 3843 - protein, 218 aa, Cucumis sativus
MGQKINPLGFRLGATQGHHSLWFAHPKKYSEGLQEDQKIRDCIQNYVQKNMRIFSGVEGIARIEIQKRIDLIQVIIFMGFPKLVIDDGSRKIEELQINVQKEFNSGNRKLNIAITRIGNPYGHPNILAEFIAGQLKNRVSFRKAMKKAIELTEQAGTKGIQVQIAGRIDGKEIARVEWIREGRVPLQTIRAKIDYCCYPVRTIYGILGIKIWIFVDEQ

SEQ ID NO: 3844 - protein, 291 aa, Bos taurus
MKSEAKDGEEESLQTAFKKLRVDASGSIASLSVGEGASVRASVRAAVEDAKPKSACASKDSWHGSTRKSSRGAVRTQRRRRSKSPVLHPPKFIHCSTIASSSSQLKHKSQTDSPDGSSGLGISTPKEFNAGECSSSLDTNHTGAVAEPLRTSVPRLPSESKEEDSSDAPQVSQASLQANDLSDFQSVSKLNLGKPCVCIGKECQCKRWHDMEVYSFSGLQNVPPLAPERRSTLEDYSQSLHTRTLSGSPRSCSEQARVYVDDVTIEDLSGYMEYYLYIPKKMSHMAEMMYT

SEQ ID NO: 3845 - protein, 102 aa, Bos taurus
MSSPPEGKLETKAGHPPAVKAGGMRIVQKHPHSGDTREEKDKDDQEWESPSPPKPTVFISGVIARGDKDFPPAAAQVAHQKPHASIDRHPSPRTQHIQQPRK

SEQ ID NO: 3846 - protein, 326 aa, Gallus gallus
MVDYYEVLGVQKHASAEDIKKAYRKLALKWHPDKNPENKEEAEQQFKQVAEAYEVLSDAKKRDIYDRFGKEGLINGGGGGSHHDNPFEFGFTFRNPDDVFREFFGGRDPFSFDFFEDPFEDFFGGRRGPRGSRSRAGGSFLSAFGGFPAFGNAFPSFDTGFTSFGSLGHGGLTSFSSTSFGGSGMGNFKSVSTSTKIVNGRKITTKRIVENGQERVEVEEDGQLRSLTINGEANEEAFAEECRRRGQHALPFQPTNTRLLKPHKPASSPRYAYHYNSDEVEEQEKSRVASSLETPFYLSGYKEGSKRRKQKQREEQKKKKSTKGSY

SEQ ID NO: 3847 - protein, 66 aa, Lactobacillus acidophilus
MPKMKTHRASAKRFKRTANGGLKRHHAFTGHRFHGKTKKQRRHLRKPAMVSRSDMKRIKQMVAQMH

SEQ ID NO: 3848 - protein, 76 aa, Lactobacillus acidophilus
MAYRESFYRYLMTQRDADSSDEVAQFANNAQHDLTFPKQEQDYEELSDYLELNASYLPSMSVFDRAYKMYEEKMMY

SEQ ID NO: 3849 - protein, 38 aa, Lactobacillus acidophilus
MKVRPSVKPMCEHCKVIKRHGRVMVICPANPKHKQRQG

SEQ ID NO: 3850 - protein, 94 aa, Lactobacillus acidophilus
MSRSIKKGPFADASLLKKVDAQADADKKQVIKTWSRRSTIFPSFVGLTIAVYDGRKHVPVYITEDMVGHKLGEFVPTRTFHGHKSTDDKATSQS

SEQ ID NO: 3851 - protein, 51 aa, Oryza sativa
  source: /note="subsp. japonica"
MPSHKTFQIKKKLAKKMRQNRPIPYWIRMRTDNTIRYNAKRRHWRRTKLGF

SEQ ID NO: 3852 - protein, 76 aa, Gallus gallus
MARGQQKIQSQQKNAKKQAEQKKKQGHDQKAAAKAALIYTCTVCRTQMPDPKTFKQHFESKHPKTPLPPELADVQA

SEQ ID NO: 3853 - protein, 262 aa, Gallus gallus; identical to SEQ ID NO: 9

SEQ ID NO: 3854 - protein, 483 aa, Bacillus licheniformis; identical to SEQ ID NO: 429

SEQ ID NO: 3855 - protein, 50 aa, Equus asinus
MARYRCCRSQSQSRCRRRRRRRCRRRRRRCVRRRRVCCRRYTVLRCRRRR

SEQ ID NO: 3856 - protein, 233 aa, Gallus gallus
MNLNFTSPVHPVPAPRPTSFFIEDILLHKPKPLREVPPEHFAGSLASRVPLLDYGYPLMPAPALLAPHPHPALHKPEHHHHHPYFLTTSGVPVPALFPHHAHAELPGKHCRRRKARTVFSDSQLSGLEKRFEIQRYLSTPERVELATALSLSETQVKTWFQNRRMKHKKQLRKSQDDPIHEENREQSSPEPELPEPAAAEPRKGPPGPFLLQDPEDEVDILEEGDILAAPHRL

SEQ ID NO: 3857 - protein, 103 aa, Lactobacillus johnsonii
MYAVIKTGGKQYKVAKGDSVFVEKLEVKPGDEVTFDEVILVNDGKSTKIGTPVVEGAKVVAKVEKQGKEKKVVTFKYKPKKHSHTKYGHRQPYTKVTIESIEA

SEQ ID NO: 3858 - protein, 109 aa, Lactobacillus johnsonii
MGKRPNFGGMGMGNMQGLIKQAKKMQQQMEAEQANLATQEFVGKAADDMVVATFSGDRKLKDLKINKEAIDPDDPDMLQDLVIDAVNKGIKAVDDATQASMGKYTKGLM

SEQ ID NO: 3859 - protein, 53 aa, Lactobacillus johnsonii
MEDKHGIKDKVAGKLKEVEGKITGDKAREVEGKAQQAKGKVKSKATEVKEDLE

SEQ ID NO: 3860 - protein, 149 aa, Solanum tuberosum
MADQLTEDQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 3861 - protein, 76 aa, Sus scrofa
AKVTEKSWQPQTTSTKRWKKRKTPSQPRSRGKVRKIYKKVKRPLHVCSRKKYSPKVITTSRRQKRARRANKFETIP

SEQ ID NO: 3862 - protein, 213 aa, Oryza sativa
  source: /note="subsp. japonica"
MGCFQSTARRPRPGYEDPVGLASETAFSVSEVEALFELFKSISGSVIDDGLINKEEFQLALFKNKRKENLFANRIFDLFDVKKRGVIDFGDFVRALNVFHPNIPMEEKIDFSFKLYDMDNTGFIERKEVKQMLIALLGESEMRLSDEIIETILDKTFSDADTNQDGRIDRTEWENFVSRNPSLLKIMTLPYLKDITTTFPSFVFNSEVDDLVT

SEQ ID NO: 3863 - protein, 76 aa, Bos taurus
MMEVESSYSDFISCDRSGRRNAVPDIQGDSEAVSVRKLAGDMGELALEGAEGQAEVGTSDKEASSQPESSDGTTSS

SEQ ID NO: 3864 - protein, 84 aa, Lactobacillus plantarum
MPIIKSAIERVKTNNKANVRNTAQMSAMRTAVKKFEAAKTAGADNVDDLYLAATSAVDKAASKGLIKRNKAARDKSRMAARYAK

SEQ ID NO: 3865 - protein, 73 aa, Lactobacillus plantarum
MSDVNKKFDSKKDQLSGKAKEVEGKVTGDRAREAQGKTQSLMGKAKDKLADAEETVKGVVDEAKDKMKKKSDD

SEQ ID NO: 3866 - protein, 76 aa, Lactobacillus plantarum
MAEQPTFEQNLSQLETIVNQLEQGDVPLEQALDQFQKGVALSKQLQATLEGAEKTLTKMMNENGDEVPFEQADANE

SEQ ID NO: 3867 - protein, 102 aa, Lactobacillus plantarum
MYAIIVTGGKQYKVEAGQAIYVEKLDAAAGDKVTFDQVVFVGGDTTKVGTPTVDGATVEGTVEKQGRDRKVVTFKYKAKKGQHTKKGHRQPYTKVTIDTINA

SEQ ID NO: 3868 - protein, 64 aa, Lactobacillus plantarum
MPKQKTNRAAAKRFKVTAKGKIKSANAFTSHRFHGKTKKQRRQLRGTAIIEKPMVKTYHKLLQK

SEQ ID NO: 3869 - protein, 91 aa, Lactobacillus plantarum
MGRSLKKGPFADAHLLKKIDAQSDSDKKSVIKTWSRRSTIFPSFIGYTIAVYDGRKHVPVYIQDDMVGHKLGEFVPTRTFHGHGTDDKKTK

SEQ ID NO: 3870 - protein, 102 aa, Lactobacillus plantarum
MMRGMGNMQSMMKQMKKMQAQMTAEQAALNEQTFTGAAPDDMVKVTFTGDKKMKDITINPDAVDPDDVDMLQDLVVAAVNDALTKVDEQTQSTMGKYTKGLQ

SEQ ID NO: 3871 - protein, 57 aa, Bifidobacterium longum
MTMAKSADIRPGITLACTECKERNYITTKNRRNTPDRLELKKFCPRCGKQTVHRETR

SEQ ID NO: 3872 - protein, 314 aa, Bacillus licheniformis; identical to SEQ ID NO: 663

SEQ ID NO: 3873 - protein, 49 aa, Sus scrofa
YLDHGLGAPAPYPDPLEPRREVCELNPDCDELADHIGFQEAYRRFYGIA

SEQ ID NO: 3874 - protein, 32 aa, Saccharomyces cerevisiae
  source: /note="strain ATCC 204508 / S288c"
MPILVWQLPKSKKLKTLKYRICFREFFDRVET

SEQ ID NO: 3875 - protein, 46 aa, Saccharomyces cerevisiae
  source: /note="strain ATCC 204508 / S288c"
MLTTQKCESREGKNDEIFELGESNSDKILLKHGKCNLFSERKPVNH

SEQ ID NO: 3876 - protein, 26 aa, Saccharomyces cerevisiae
  source: /note="strain ATCC 204508 / S288c"
MRLNYSRCYYSSQRRRQSLPKRFPLI

SEQ ID NO: 3877 - protein, 3562 aa, Gallus gallus
MLLNIKSIIWMCSTLAITYMLPKVKAEKKTLVKGSLSGTSVLPCFFSTTPTIASSYAAEYLRIKWSKVELDKSGKDAKETTVLVAQNGNIKIGQNYKDRVSVPTHSEETGDASLTFSRLRASDAGVYRCDVMYGVEDTQGIVSLAVDGVVFHYRAATSRYTLNFTQAQQTCLDNGAVIASPEQLKAAYEDGFEQCDAGWLSDQTVRYPIRHPRIGCFGDKMGKKGVRTYGRRFPNETYDVYCYVEHMQDEVVHVSVPEKLTFEEAKELCRKRDGVLASVGNMYVAWRNGFDQCDYGWLADGSVRYPASVARPQCGGGLLGVRTLYRYENQTGFPYPDSKFDAYCYERKKIVSEPTTVKLVTTLKTDSVELSSAKVTLKPSVFESSVTEVAVTKTKVPAWEEATLETEDTKMTTEVAEEKREMEVLMENIKLTTLLPQTVTDGEISPYDTLGRTEYDVSPRLTESTSAALEVEHTYSEAELSEEQGRSESTEDAFLTSVVFQDSTAVAKSSTGSWEDIETGDTQKHDGDNQTEQIEVGPVMTATDSLVPASQRELPRTGSSVSLTKENLYLGSHSTKEPTKKSMEAKSDKKLTTVVIPKALFTDQYDLTTGGEGRESMYTVMPDRVSGVALVSIPESDVPAVSETLMDELAVTTGQSSTADESTPFIKFSSSATELDNEASAEGSREDLKDVHLTTSSGIPVSFTLFTANETGSEVTALSESTSAPQKFEEGITSVLHSSQQTEGSAILEKQEKTKEPEMSTIDAKVLYITTVVPASVTAGSEGRFGSEKFTHTPPVSGMWLQTDKDQVYMTEETSHTKRIELDTEDDISGMEPTSSPGQIIEYTKHLGAPVSAVTDETKTSMETAETESDEEVVSADFDQTKGTTEVFHTSSSLDLEKFTLSKIPEDESSATVKSFSSSSGTVLPTAVATVLEVTDHEADETSGYVLNMTFSTPEGEQRKATEKSPATSAEDEVSTGTEISKYTMTEGGQISSVTSAEKESVAALQEREEQPSVGLPETKEPFKFTDVTEIETTVPQREGDTSLVPVTVGSEDIGEMQVTDHTSFDSIIHTEATVTSTKASEVFPKELSTKDQDRELGTAMGSTLPVTSVQMHEQKTTAGFESPQTTTQEKHDEMGSAYDEMYPATELSVPALMLTEYGQVSGPVETSTRSLHLTGTPKAETATDQEEKITEAVPVTFGTQAKVYESKGTTTREEDRDVGSWNSVLPPHTMLSSPSTAGSISLLTLGASPSQTPEGSGISEELEEVKTVPFSSRATDKTTVISDLTTSSISAVDKIQPTSASKPFVSSKSPRIIPEEDEEVTSSDIIVIDESISPSKASAEDDLTGKMVEPEIDKEYFTSSTATAVARPTAPPTVMEATEALQPQEVSPTSHPDSGTDIRLYVIQITGNDTDHPVNEFLDLFSRHILPHAVDETHTDAESAQTEPCTSDSVQDSSEYIILDPFFPNFMDFEEEEEDCENTTDVTTPPALQFINGKQQVTSAPKSTKAEEARSDQIESVAHSKNVTFSQINETNTFIISETEASGTMQPSKAGEVMGAFEVTQPTADVAMLEPVYSGESEVTTTDKYLEITSVYEQSPKKNKETVMWHGTEESSTKDTKNLLLITNESSGDGSTESDLSRSVFTEILTMSSHEDSEKISHTTSVPTILSVERSAVTAAPSADSDTATVGIDVKDLIPKGGTATPGNYYKSTIKLDAEFPFESNPEATSHTTKPDMTASSFIVLEGSGDVEENSTLASAMTTETAVAETLSVQDTSLGSGTVLPTEISVTISEITPALPGGTRILYSTFDQSSEATVSTNFVSELIMEQVVGSSVATEKKVEDEKEVQTTVYSSQEISTTDAKGKSELDEFGSTTNEVRTVSQEPTPLREIVPITGTMHSEIKKVTATPFLREKLFINEGSAEEPADLFAGSPTRKVVSTDSPFTDSGSGDIDVITESATLTSVPSRSVIETQTVKHEGNINVISVSLKNTTTEYEEHIGTGGPVTSVSSTGSDGLTEESEVAIEMSENVFSTENQGEPTQEAVPTYTAPSDIKSRLGSRREVTSHVTPVIRTKDLETAEVTSSPESVVNNSTLDTMVTHGTIRAVAESTESKKGKGSFSAVSLGKILMIEHGSGEELKVDSSTTKLMSNGPTEKLLGSHFSFFDQGSGEAETLTESFTKASVSPTGKPEPQEQYGRKTVSMPSAVVHAYTAEPNELVTSTEHDITSLQTVTDTEMEEKAANELTVTSFATNLPLSEDVHSWEDRPREILPKAIESSGEATEDPFFISTQANHEHVEFLSVPTIRPHSEENKVEAESDEKILLPFNNDRVTESAVIERKYLSSPFTDTEQEEELVQNIFPTEDIPRLFLTPKEEKPTNNELISDPLFSGQGSGDEFTVIPSVESLAVKETTNTLSPWPFHPASVGPKLSTDKTQVFESGSTDSNAEINEEITTTAAELTETAYSMATSSPALEEESSSHSNSKDKDITHYFLVIEDPYNKEMDHRRGENGTSRPLPTPGDVSLEESSHMLTTDDVTPVSVILSETPYLEMGKSLATSATKMPSRVLPESSGEGSGWDGVSDSFAPDTLTHSTAPSVMEVELTASSHIPGVYSEVMTTHVPGDGSQTVITGLASLFTEEKEIVANRTAADPKTGTSEELTSDTGMSLDIIPVVDDRRHVTLNVSVYGDITLIEERLQIPSEKTTIIDMDHSKSMPEDIISVQTMPNLVIRSTQVSDDNMKAEEDKYDSILNFSTVEENSFGSGDNLSLTTSIQPSSESVTAGHGPKLVDKDLGSGYAMQFATETLTTTVLNELGIFLPTVPSLVSPHMPHESKESEFEAKHIGRTSTTDDVYEPYTSANNQVITDQSKTMSISGFSGMGQEESGDKKPMIPSLTPDLTMETEKALTTDTFDVSMVTTQSMSQHATVSSSSSEEKHSTVYMQTKSASTEYEETDSVSLNSVSQNPKSSVTVWLVNGVSKYPEVIIPSTSSAKDSDQSDHSSDGTFKEVSSDMAATYKPPTTDLDTTVSSLLVFSPEPESESISTESTPHFNKFVTERSEETESSVNDLIIEENATVSGDSPSIHDYPTAFWNFGERTSTDVPKLSTIEVEFSSERVKNPSQESDRSTERERPRLSSAPVSDSPNSIEVGVFKPDQEAVTMLTSSLEPLDRSLETQSALLGPLLGQQEITTISSNIATNNTAPGNNPYSNEQSTISSELLNTIELVTSSFSLPEVTNGSDFLIGTSVGSVEGTAVQIPGQDPCKSNPCLNGGTCYPRGSFYICTCLPGFNGEQCELDIDECQSNPCRNGATCIDGLNTFTCLCLPSYIGALCEQDTETCDYGWHKFQGQCYKYFAHRRTWDTAERECRLQGAHLTSILSHEEQVFVNRIGHDYQWIGLNDKMFERDFRWTDGSPLQYENWRPNQPDSFFSAGEDCVVIIWHENGQWNDVPCNYHLTYTCKKGTVACGQPPVVENAKTFGKMKPRYEINSLIRYHCKDGFIQRHIPTIRCQGNGRWDMPKITCMNPSTYQRTYSKKYYYKHSSSGKGTSLNSSKHYHRWIRTWQDSRR

SEQ ID NO: 3878 - protein, 65 aa, Carica papaya
MSDTCGNCDCADKTQCVKKGSSYTADIIETEKSIMTVVMDAPAAENDGKCKCGPSCSCTNCTCGH

SEQ ID NO: 3879 - protein, 51 aa, Gallus gallus
MSSHKTFKIKRFLAKKQKQNRPIPQWIRMKTGNKIRYNSKRRHWRRTKLGL

SEQ ID NO: 3880 - protein, 45 aa, Coturnix japonica
MCDKPDLSEVEKFDKKKLKKTNTEEKNTLPSKETIEQEKECVKSS

SEQ ID NO: 3881 - protein, 127 aa, Bos taurus
MDVFKKGFSIAKEGVVGAVEKTKQGVTEAAEKTKEGVMYVGAKTKEGVVQSVTSVAEKTKEQANAVSEAVVSSVNTVATKTVEEVENIAVTSGVVHKEALKQPVPSQEDEAAKAEEQVAEETKSGGD

SEQ ID NO: 3882 - protein, 131 aa, Saccharomyces cerevisiae
  source: /note="strain ATCC 204508 / S288c"
MSEDLSPTSSRVDLSNPHGFTKEGVDLSKLSPQELKLYKMYGKLPSKKDLLRHKMQDRQYFDSGDYALKKAGVIKSDDVIVNNSSNNLPVTNPSGLRESIIRRRMSSSSGGDSISRQGSISSGPPPRSPNK

SEQ ID NO: 3883 - protein, 420 aa, Zea mays; identical to SEQ ID NO: 108

SEQ ID NO: 3884 - protein, 78 aa, Saccharomyces cerevisiae
  source: /note="strain ATCC 204508 / S288c"
MSQNNTISSMNPERAYNNVTLKNLTAFQLLSQRENICELLNLVESTERHNSIINPERQRMSLEEMKKMLDALKNERKK

SEQ ID NO: 3885 - protein, 239 aa, Bos taurus
MSRSNRQKEYKCGDLVFAKMKGYPHWPARIDEMPEAAVKSTANKYQVFFFGTHETAFLGPKDLFPYEESKEKFGKPNKRKGFSEGLWEIENNPTVKASGYQSSQKKSCVEEPEPEPEATEGDGDKKGNAEGSSDEEGKLVIDEPTKEKNEKGALKRRAGDLLEDSPKRPKEAEDLEGEEKEGATLEGERPLPVEAEKNSTPSEPGSGRGPPQEEEEEEEEEEAAKEDAEAPGLRDHESL

SEQ ID NO: 3886 - protein, 138 aa, Cucurbita maxima
MGMGMMEVHLISGKGLQAHDPLNKPIDPYAEINFKGQERMSKVAKNAGPDPIWNEKFKFLVEYPGSGGDFHILFKVMDHDAIDGDDYIGDVKIDVQNLLAEGVRKGWSELPPRMYQVLAHKIYFKGEIEVGVFFQRQG

SEQ ID NO: 3887 - protein, 150 aa, Cucurbita maxima
MGMGMMEVHLISGKGLQAHDPLNKPIDPYAEINFKGQERMSKVAKNAGPNPLWDEKFKFLAEYPGSGGDFHILFKVMDHDAIDGDDYIGDVKIDVKNLLAEGVRKGKSEMPPRMYHVLAHKIHFKGEIEVGVSFKLQGGGGCGGCYPWEN

SEQ ID NO: 3888 - protein, 51 aa, Saccharomyces cerevisiae
  source: /note="strain ATCC 204508 / S288c"
MKMKTNKYMNMVRPAPPRRADPEGVRDPSTMGGGPNPFLRRSPYMYINKKK

SEQ ID NO: 3889 - protein, 3260 aa, Ovis aries; identical to SEQ ID NO: 836

SEQ ID NO: 3890 - protein, 61 aa, Bos taurus
NSPESYLSSKTRSSKLDDNYLKELNEDLKLRKQELLEILKPLEDKNNLLFQKLMSNLEEKQ

SEQ ID NO: 3891 - protein, 51 aa, Saccharomyces cerevisiae
  source: /note="strain ATCC 204508 / S288c"
TNLHMMLPPNHRKTWYALDDFRKDNLKTDEKRINKLFDLDPFKTMVEDRKL

SEQ ID NO: 3892 - protein, 51 aa, Saccharomyces cerevisiae
  source: /note="strain ATCC 204508 / S288c"
KVPEHDQQLNTFEKRYDELFDAQFNKLEFFKIRMKKLKKNKPIEKKNYKIW

SEQ ID NO: 3893 - protein, 56 aa, Saccharomyces cerevisiae
  source: /note="strain ATCC 204508 / S288c"
KVPEHDQQLNTFEKRYDELFDAQFNKLEFFKIRMKKLKKNKPIEKKNYKIWCLEKE

SEQ ID NO: 3894 - protein, 61 aa, Saccharomyces cerevisiae
  source: /note="strain ATCC 204508 / S288c"
KVPEHDQQLNTFEKRYDELFDAQFNKLEFFKIRMKKLKKNKPIEKKNYKIWCLEKEDLKDL

SEQ ID NO: 3895 - protein, 66 aa, Saccharomyces cerevisiae
  source: /note="strain ATCC 204508 / S288c"
KVPEHDQQLNTFEKRYDELFDAQFNKLEFFKIRMKKLKKNKPIEKKNYKIWCLEKEDLKDLVWDPL

SEQ ID NO: 3896 - protein, 51 aa, Gallus gallus
DMEKRVIKWFDYLWTNKKAVDEREVLKYLPDKLRAEIAINVHLETLKKVRI

SEQ ID NO: 3897 - protein, 51 aa, Bos taurus
KDMEKRVIKWFDYLWTNKKTVDEREVLKYLPDKLRAEIAINVHLDTLKKVR

SEQ ID NO: 3898 - protein, 56 aa, Bos taurus
KDMEKRVIKWFDYLWTNKKTVDEREVLKYLPDKLRAEIAINVHLDTLKKVRIFADC

SEQ ID NO: 3899 - protein, 56 aa, Gallus gallus
MHFRKVTKDLEARVIKWFDYLWTNKKTVDEKEVLKNLPDKLKAEIAINVHLDTLKK

SEQ ID NO: 3900 - protein, 51 aa, Bos taurus
WNKTIDAMKRVEEIKQKRQAKFIMNRLKKNKELQKVQDVKEVKQNIHLIRA

SEQ ID NO: 3901 - protein, 51 aa, Bos taurus
EELKNFLKDLLEKANKTVDDTKLAEYTDLMLKLFDSNNDGKLELTEMARLL

SEQ ID NO: 3902 - protein, 51 aa, Bos taurus
LKRRLPTQPSDHSYALLDLDTLKKKLFLTLKENEKLRRRLKAQRLVMRRMC

SEQ ID NO: 3903 - protein, 51 aa, Bos taurus
FKRLQHLLKEKKRRYLHNRKVEHEALGSSLLTGPEGLLAKERENLKRLKCL

SEQ ID NO: 3904 - protein, 66 aa, Oryza sativa
  source: /note="subsp. japonica"
SPLGASAEREREVREAEMLLRAIAERYDDCFLRLRDAAAELSDLHRERLRLAAENLHLSLLLEELE

SEQ ID NO: 3905 - protein, 51 aa, Coturnix japonica
SLNLSSNKLYRLDDLAELAIKAAGLKVLDLSRNELKSERELDKVKGLKLEE

SEQ ID NO: 3906 - protein, 51 aa, Saccharomyces cerevisiae
  source: /note="strain YJM789"
RKDITICLNDLCRINDLLVSHDGLLKREIGSLLRDKQELLELNEREQLLWK

SEQ ID NO: 3907 - protein, 56 aa, Saccharomyces cerevisiae
  source: /note="strain ATCC 204508 / S288c"
VFEELRNSATTLQEDELLLETCENELKRLEEKLTLYKPILKLISDFESLQEDQEFL

SEQ ID NO: 3908 - protein, 56 aa, Solanum demissum
CKDLLLSLLRDAIGEESERRELPDNELADMLRKTLLPRRYLILVDDVWDNSAWDDL

SEQ ID NO: 3909 - protein, 56 aa, Solanum tuberosum
DHVEDKNVETLLERLLEAREELRPLLLKPNNRLKDLLFLDIALDSTVRTAVERGYE

SEQ ID NO: 3910 - DNA, 43 bp, Artificial Sequence
  source: /note="Description of Artificial Sequence: Synthetic oligonucleotide"
cagtggtatcaacgcagagtggccattacggccaagttacggg

SEQ ID NO: 3911 - DNA, 48 bp, Artificial Sequence
  source: /note="Description of Artificial Sequence: Synthetic oligonucleotide"
cagtggtatcaacgcagagtggccgaggcggccttttttttttttttt

SEQ ID NO: 3912 - DNA, 22 bp, Artificial Sequence
  source: /note="Description of Artificial Sequence: Synthetic primer"
tacgtgtatggccgcctcggcc

SEQ ID NO: 3913 - DNA, 22 bp, Artificial Sequence
  source: /note="Description of Artificial Sequence: Synthetic primer"
tacgtgtatggccgtaatggcc

SEQ ID NO: 3914 - protein, 8 aa, Artificial Sequence
  source: /note="Description of Artificial Sequence: Synthetic peptide"
DYKDDDDK

SEQ ID NO: 3915 - protein, 22 aa, Artificial Sequence
  source: /note="Description of Artificial Sequence: Synthetic peptide"
DYKDHDGDYKDHDIDYKDDDDK

SEQ ID NO: 3916 - protein, 20 aa, Artificial Sequence
  source: /note="Description of Artificial Sequence: Synthetic peptide"
MGSSHHHHHHSSGLVPRGSH

SEQ ID NO: 3917 - protein, 11 aa, Artificial Sequence
  source: /note="Description of Artificial Sequence: Synthetic peptide"
MGSHHHHHHHH

SEQ ID NO: 3918 - protein, 19 aa, Artificial Sequence
  source: /note="Description of Artificial Sequence: Synthetic peptide"
MGSHHHHHHHHSENLYFQG

SEQ ID NO: 3919 - protein, 8 aa, Artificial Sequence
  source: /note="Description of Artificial Sequence: Synthetic 8xHis tag"
HHHHHHHH

SEQ ID NO: 3920 - DNA, 57 bp, Artificial Sequence
  source: /note="Description of Artificial Sequence: Synthetic oligonucleotide"
atgaaaaagatttggctggcgctggctggtttagttttagcgtttagcgcatcggcg

SEQ ID NO: 3921 - protein, 32 aa, Bacillus subtilis
MKKKKTWKRFLHFSSAALAAGLIFTSAAPAEA

SEQ ID NO: 3922 - protein, 29 aa, Bacillus subtilis
MKRSISIFITCLLITLLTMGGMIASPASA

SEQ ID NO: 3923 - protein, 30 aa, Bacillus subtilis
MRKKTKNRLISSVLSTVVISSLLFPGAAGA

SEQ ID NO: 3924 - protein, 26 aa, Bacillus subtilis
MRKNRILALFVLSLGLLSFMVTPVSA

SEQ ID NO: 3925 - protein, 32 aa, Bacillus subtilis
MKFVKRRIIALVTILMLSVTSLFALQPSAKAA

SEQ ID NO: 3926 - protein, 25 aa, Bacillus subtilis
MKSCKQLIVCSLAAILLLIPSVSFA

SEQ ID NO: 3927 - protein, 26 aa, Bacillus subtilis
MKKKLAAGLTASAIVGTTLVVTPAEA

SEQ ID NO: 3928 - protein, 34 aa, Bacillus subtilis
MKLVPRFRKQWFAYLTVLCLALAAAVSFGVPAKA

SEQ ID NO: 3929 - protein, 28 aa, Bacillus subtilis
MRNLTKTSLLLAGLCTAAQMVFVTHASA

SEQ ID NO: 3930 - protein, 24 aa, Bacillus subtilis
MKRLCLWFTVFSLFLVLLPGKALG

SEQ ID NO: 3931 - protein, 36 aa, Bacillus subtilis
MKLKTKASIKFGICVGLLCLSITGFTPFFNSTHAEA

SEQ ID NO: 3932 - protein, 32 aa, Bacillus subtilis
MKKFPKKLLPIAVLSSIAFSSLASGSVPEASA

SEQ ID NO: 3933 - protein, 32 aa, Bacillus subtilis
MKKRKRRNFKRFIAAFLVLALMISLVPADVLA

SEQ ID NO: 3934 - protein, 28 aa, Bacillus subtilis
MFKFKKNFLVGLSAALMSISLFSATASA

SEQ ID NO: 3935 - protein, 28 aa, Bacillus subtilis
MKRMIVRMTLPLLIVCLAFSSFSASARA

SEQ ID NO: 3936 - protein, 26 aa, Bacillus subtilis
MKRITINIITMFIAAAVISLTGTAEA

SEQ ID NO: 3937 - protein, 28 aa, Bacillus subtilis
MRKKRVITCVMAASLTLGSLLPAGYASA

SEQ ID NO: 3938 - protein, 29 aa, Bacillus subtilis
MKKKQVMLALTAAAGLGLTALHSAPAAKA

SEQ ID NO: 3939 - protein, 21 aa, Bacillus subtilis
MKWMCSICCAAVLLAGGAAQA

SEQ ID NO: 3940 - protein, 26 aa, Bacillus subtilis
MKKELLASLVLCLSLSPLVSTNEVFA

SEQ ID NO: 3941 - protein, 26 aa, Bacillus subtilis
MNFKKTVVSALSISALALSVSGVASA

SEQ ID NO: 3942 - protein, 28 aa, Bacillus subtilis
MKRLFMKASLVLFAVVFVFAVKGAPAKA

SEQ ID NO: 3943 - protein, 26 aa, Bacillus subtilis
MLKKKWMVGLLAGCLAAGGFSYNAFA

SEQ ID NO: 3944 - protein, 27 aa, Bacillus subtilis
MKKIGLLFMLCLAALFTIGFPAQQADA

SEQ ID NO: 3945 - protein, 25 aa, Bacillus subtilis
MRFTKVVGFLSVLGLAAVFPLTAQA

SEQ ID NO: 3946 - protein, 28 aa, Bacillus subtilis
MKQGKFSVFLILLLMLTLVVAPKGKAEA

SEQ ID NO: 3947 - protein, 28 aa, Bacillus subtilis
MTLTKLKMLSMLTVMIASLFIFSSQALA

SEQ ID NO: 3948 - protein, 30 aa, Bacillus subtilis
MKRKLLSSLAISALSLGLLVSAPTASFAAE

SEQ ID NO: 3949 - protein, 28 aa, Bacillus subtilis
MTKKAWFLPLVCVLLISGWLAPAASASA

SEQ ID NO: 3950 - protein, 30 aa, Bacillus subtilis
MRKSLITLGLASVIGTSSFLIPFTSKTASA

SEQ ID NO: 3951 - protein, 26 aa, Bacillus subtilis
MKRIRIPMTLALGAALTIAPLSFASA

SEQ ID NO: 3952 - protein, 21 aa, Bacillus subtilis
MRKYTVIASILLSFLSVLSGG

SEQ ID NO: 3953 - protein, 31 aa, Bacillus subtilis
MKKLLTVMTMAVLTAGTLLLPAQSVTPAAHA

SEQ ID NO: 3954 - protein, 30 aa, Bacillus subtilis
MNKPTKLFSTLALAAGMTAAAAGGAGTIHA

SEQ ID NO: 3955 - protein, 41 aa, Bacillus subtilis
MVKSFRMKALIAGAAVAAAVSAGAVSDVPAAKVLQPTAAYA

SEQ ID NO: 3956 - protein, 32 aa, Bacillus subtilis
MKWNNMLKAAGIAVLLFSVFAYAAPSLKAVQA

SEQ ID NO: 3957 - protein, 16 aa, Aspergillus sp.
MRWLLTSSALLVPAAA

SEQ ID NO: 3958 - protein, 26 aa, Aspergillus sp.
MKFLKAKGSLLSSGIYLIALAPFVNA

SEQ ID NO: 3959 - protein, 23 aa, Aspergillus sp.
MNFKNIFLSFFFVLAVGLALVHA

SEQ ID NO: 3960 - protein, 21 aa, Aspergillus sp.
MKQFSAKYALILLATAGQALA

SEQ ID NO: 3961 - protein, 19 aa, Aspergillus sp.
MKLSSACAIALLAAQAAGA

SEQ ID NO: 3962 - protein, 20 aa, Aspergillus sp.
MKYSTIFSAAAAVFAGSAAA

SEQ ID NO: 3963 - protein, 18 aa, Aspergillus sp.
MKFSTILTGSLFATAALA

SEQ ID NO: 3964 - protein, 22 aa, Aspergillus sp.
MIGSSHAVVALGLFTLYGHSAA

SEQ ID NO: 3965 - protein, 19 aa, Aspergillus sp.
MPRTSLLTLACALATGASA

SEQ ID NO: 3966 - protein, 22 aa, Aspergillus sp.
MRPLSHLSFFNGLLLGLSALSA

SEQ ID NO: 3967 - protein, 18 aa, Aspergillus sp.
MGALRWLSIAATASTALA

SEQ ID NO: 3968 - protein, 23 aa, Aspergillus sp.
MGVSAVLLPLYLLSGVTSGLAVP

SEQ ID NO: 3969 - protein, 14 aa, Aspergillus sp.
MLPLLLCIVPYCWS

SEQ ID NO: 3970 - protein, 18 aa, Aspergillus sp.
MHFLQNAVVAATMGAALA

SEQ ID NO: 3971 - protein, 20 aa, Aspergillus sp.
MKGTAASALLIALSATAAQA

SEQ ID NO: 3972 - protein, 16 aa, Aspergillus sp.
MKGILGLSLLPLLTAA

SEQ ID NO: 3973 - protein, 18 aa, Aspergillus sp.
MKFSTILTGSLFATAALA

SEQ ID NO: 3974 - protein, 22 aa, Aspergillus sp.
MIGSSHAVVALGLFTLYGHSAA

SEQ ID NO: 3975 - protein, 26 aa, Aspergillus sp.
MMYSKLLTLTTLLLPTALALPSLVER

SEQ ID NO: 3976 - protein, 18 aa, Aspergillus sp.
MHSYQLLGLAAVGSLVSA

SEQ ID NO: 3977 - protein, 21 aa, Aspergillus sp.
MQSIKRTLLLLGAILPAVLGA

SEQ ID NO: 3978 - protein, 20 aa, Aspergillus sp.
MHYKLLFAAAAASLASAVSA

SEQ ID NO: 3979 - protein, 20 aa, Aspergillus sp.
MPRLLPISAATLALAQLTYG

SEQ ID NO: 3980 - protein, 19 aa, Aspergillus sp.
MPRTSLLTLACALATGASA

SEQ ID NO: 3981 - protein, 18 aa, Aspergillus sp.
MRQHSRMAVAALAAGANA

SEQ ID NO: 3982 - protein, 20 aa, Aspergillus sp.
MRSFAPWLVSLLGASAVVAA

SEQ ID NO: 3983 - protein, 18 aa, Aspergillus sp.
MLTKNLLLCFAAAKAALA

SEQ ID NO: 3984 - protein, 19 aa, Aspergillus sp.
MAVLSVLLPITFLLSSVTG

SEQ ID NO: 3985 - protein, 18 aa, Aspergillus sp.
MGALRWLSIAATASTALA

SEQ ID NO: 3986 - protein, 23 aa, Aspergillus sp.
MGVSAVLLPLYLLSGVTSGLAVP

SEQ ID NO: 3987 - protein, 20 aa, Aspergillus sp.
MVVFSKTAALVLGLSTAVSA

SEQ ID NO: 3988 - protein, 25 aa, Aspergillus sp.
MVKLTHLLARAWLVPLAYGASQSLL

SEQ ID NO: 3989 - protein, 25 aa, Aspergillus sp.
MVAFSALSGVSAVSLLLSLVQNAHG

SEQ ID NO: 3990 - protein, 18 aa, Aspergillus sp.
MSFRSLLALSGLVCTGLA

SEQ ID NO: 3991 - protein, 19 aa, Aspergillus sp.
MFTKQSLVTLLGGLSLAVA

SEQ ID NO: 3992 - protein, 18 aa, Aspergillus sp.
MFSRRNLVALGLAATVSA

SEQ ID NO: 3993 - protein, 6 aa, Unknown
  source: /note="Description of Unknown: Kexin protease site peptide"
NVISKR

SEQ ID NO: 3994 - protein, 21 aa, Unknown
  source: /note="Description of Unknown: Ig-Kappa peptide"
METDTLLLWVLLLWVPGSTGD

SEQ ID NO: 3995 - protein, 11 aa, Artificial Sequence
  source: /note="Description of Artificial Sequence: Synthetic peptide"
LFDKDNNGSIS

SEQ ID NO: 3996 - protein, 8 aa, Artificial Sequence
  source: /note="Description of Artificial Sequence: Synthetic peptide"
FDKDNNGS

SEQ ID NO: 3997 - protein, 10 aa, Artificial Sequence
  source: /note="Description of Artificial Sequence: Synthetic peptide"
FDKDNNGSIS

SEQ ID NO: 3998 - protein, 11 aa, Artificial Sequence
  source: /note="Description of Artificial Sequence: Synthetic peptide"
FDKDNNGSISS

SEQ ID NO: 3999 - protein, 14 aa, Artificial Sequence
  source: /note="Description of Artificial Sequence: Synthetic peptide"
FDKDNNGSISSSEL

SEQ ID NO: 4000 - protein, 8 aa, Artificial Sequence
  source: /note="Description of Artificial Sequence: Synthetic peptide"
DKDNNGSI

SEQ ID NO: 4001 - protein, 9 aa, Artificial Sequence
  source: /note="Description of Artificial Sequence: Synthetic peptide"
DKDNNGSIS

SEQ ID NO: 4002 - protein, 8 aa, Artificial Sequence
  source: /note="Description of Artificial Sequence: Synthetic peptide"
SLGLSPSE

SEQ ID NO: 4003 - protein, 8 aa, Artificial Sequence
  source: /note="Description of Artificial Sequence: Synthetic peptide"
NEIDVDGN

SEQ ID NO: 4004 - protein, 7 aa, Artificial Sequence
  source: /note="Description of Artificial Sequence: Synthetic peptide"
IDVDGNH

SEQ ID NO: 4005 - protein, 8 aa, Artificial Sequence
  source: /note="Description of Artificial Sequence: Synthetic peptide"
IDVDGNHQ

SEQ ID NO: 4006 - protein, 10 aa, Artificial Sequence
  source: /note="Description of Artificial Sequence: Synthetic peptide"
IDVDGNHQIE

SEQ ID NO: 4007 - protein, 9 aa, Artificial Sequence
  source: /note="Description of Artificial Sequence: Synthetic peptide"
KVFDKNGDG

SEQ ID NO: 4008 - protein, 11 aa, Artificial Sequence
  source: /note="Description of Artificial Sequence: Synthetic peptide"
VFDKNGDGLIS

SEQ ID NO: 4009 - protein, 7 aa, Artificial Sequence
  source: /note="Description of Artificial Sequence: Synthetic peptide"
DKNGDGL

SEQ ID NO: 4010 - protein, 7 aa, Artificial Sequence
  source: /note="Description of Artificial Sequence: Synthetic peptide"
KLTDAEV

SEQ ID NO: 4011 - protein, 16 aa, Artificial Sequence
  source: /note="Description of Artificial Sequence: Synthetic peptide"
LREVSDGSGEINIQQF

SEQ ID NO: 4012 - protein, 8 aa, Artificial Sequence
  source: /note="Description of Artificial Sequence: Synthetic peptide"
REVSDGSG

SEQ ID NO: 4013 - protein, 9 aa, Artificial Sequence
  source: /note="Description of Artificial Sequence: Synthetic peptide"
REVSDGSGE

SEQ ID NO: 4014 - protein, 10 aa, Artificial Sequence
  source: /note="Description of Artificial Sequence: Synthetic peptide"
REVSDGSGEI

SEQ ID NO: 4015 - protein, 11 aa, Artificial Sequence
  source: /note="Description of Artificial Sequence: Synthetic peptide"
REVSDGSGEIN

SEQ ID NO: 4016 - protein, 13 aa, Artificial Sequence
  source: /note="Description of Artificial Sequence: Synthetic peptide"
REVSDGSGEINIQ

SEQ ID NO: 4017 - protein, 15 aa, Artificial Sequence
  source: /note="Description of Artificial Sequence: Synthetic peptide"
REVSDGSGEINIQQF

SEQ ID NO: 4018 - protein, 9 aa, Artificial Sequence
  source: /note="Description of Artificial Sequence: Synthetic peptide"
EVSDGSGEI

SEQ ID NO: 4019 - protein, 10 aa, Artificial Sequence
  source: /note="Description of Artificial Sequence: Synthetic peptide"
EVSDGSGEIN

SEQ ID NO: 4020 - protein, 12 aa, Artificial Sequence
  source: /note="Description of Artificial Sequence: Synthetic peptide"
YSFEDSGVGDVT

SEQ ID NO: 4021 - protein, 13 aa, Artificial Sequence
  source: /note="Description of Artificial Sequence: Synthetic peptide"
YSFEDSGVGDVTG

SEQ ID NO: 4022 - protein, 12 aa, Artificial Sequence
  source: /note="Description of Artificial Sequence: Synthetic peptide"
SFEDSGVGDVTG

SEQ ID NO: 4023 - protein, 9 aa, Artificial Sequence
  source: /note="Description of Artificial Sequence: Synthetic peptide"
FEDSGVGDV

SEQ ID NO: 4024 - protein, 9 aa, Artificial Sequence
  source: /note="Description of Artificial Sequence: Synthetic peptide"
EDSGVGDVT

SEQ ID NO: 4025 - protein, 10 aa, Artificial Sequence
  source: /note="Description of Artificial Sequence: Synthetic peptide"
EDSGVGDVTG

SEQ ID NO: 4026 - protein, 11 aa, Artificial Sequence
  source: /note="Description of Artificial Sequence: Synthetic peptide"
EDSGVGDVTGF

SEQ ID NO: 4027 - protein, 8 aa, Artificial Sequence
  source: /note="Description of Artificial Sequence: Synthetic peptide"
DSGVGDVT

SEQ ID NO: 4028 - protein, 7 aa, Artificial Sequence
  source: /note="Description of Artificial Sequence: Synthetic peptide"
  MOD_RES (4)..(4): D-amino acid
LRGNGYD

SEQ ID NO: 4029 - protein, 10 aa, Artificial Sequence
  source: /note="Description of Artificial Sequence: Synthetic peptide"
  MOD_RES (4)..(4): D-amino acid
LRGNGYDIDV

SEQ ID NO: 4030 - protein, 10 aa, Artificial Sequence
  source: /note="Description of Artificial Sequence: Synthetic peptide"
ITHTNDIVPR

SEQ ID NO: 4031 - protein, 8 aa, Artificial Sequence
  source: /note="Description of Artificial Sequence: Synthetic peptide"
HTNDIVPR

SEQ ID NO: 4032 - protein, 7 aa, Artificial Sequence
  source: /note="Description of Artificial Sequence: Synthetic peptide"
TNDIVPR

SEQ ID NO: 4033 - protein, 6 aa, Artificial Sequence
  source: /note="Description of Artificial Sequence: Synthetic peptide"
NDIVPR

SEQ ID NO: 4034 - protein, 7 aa, Artificial Sequence
  source: /note="Description of Artificial Sequence: Synthetic peptide"
YSHSSPE

SEQ ID NO: 4035 - protein, 26 aa, Artificial Sequence
  source: /note="Description of Artificial Sequence: Synthetic peptide"
DIVKIEGIDATGGNNQPNIPDIPAHL

SEQ ID NO: 4036 - protein, 6 aa, Artificial Sequence
  source: /note="Description of Artificial Sequence: Synthetic peptide"
KIEGID

SEQ ID NO: 4037 - protein, 21 aa, Artificial Sequence
  source: /note="Description of Artificial Sequence: Synthetic peptide"
KIEGIDATGGNNQPNIPDIPA

SEQ ID NO: 4038 - protein, 20 aa, Artificial Sequence
  source: /note="Description of Artificial Sequence: Synthetic peptide"
IEGIDATGGNNQPNIPDIPA

SEQ ID NO: 4039 - protein, 19 aa, Artificial Sequence
  source: /note="Description of Artificial Sequence: Synthetic peptide"
EGIDATGGNNQPNIPDIPA

SEQ ID NO: 4040 - protein, 18 aa, Artificial Sequence
  source: /note="Description of Artificial Sequence: Synthetic peptide"
GIDATGGNNQPNIPDIPA

SEQ ID NO: 4041 - protein, 14 aa, Artificial Sequence
  source: /note="Description of Artificial Sequence: Synthetic peptide"
IDATGGNNQPNIPD

SEQ ID NO: 4042 - protein, 16 aa, Artificial Sequence
  source: /note="Description of Artificial Sequence: Synthetic peptide"
IDATGGNNQPNIPDIP

SEQ ID NO: 4043 - protein, 17 aa, Artificial Sequence
  source: /note="Description of Artificial Sequence: Synthetic peptide"
IDATGGNNQPNIPDIPA

SEQ ID NO: 4044 - protein, 18 aa, Artificial Sequence
  source: /note="Description of Artificial Sequence: Synthetic peptide"
IDATGGNNQPNIPDIPAH

SEQ ID NO: 4045 - protein, 16 aa, Artificial Sequence
  source: /note="Description of Artificial Sequence: Synthetic peptide"
DATGGNNQPNIPDIPA

SEQ ID NO: 4046 - protein, 12 aa, Artificial Sequence
  source: /note="Description of Artificial Sequence: Synthetic peptide"
ATGGNNQPNIPD

SEQ ID NO: 4047 - protein, 14 aa, Artificial Sequence
  source: /note="Description of Artificial Sequence: Synthetic peptide"
ATGGNNQPNIPDIP

SEQ ID NO: 4048 - protein, 15 aa, Artificial Sequence
  source: /note="Description of Artificial Sequence: Synthetic peptide"
ATGGNNQPNIPDIPA

SEQ ID NO: 4049 - protein, 16 aa, Artificial Sequence
  source: /note="Description of Artificial Sequence: Synthetic peptide"
ATGGNNQPNIPDIPAH

SEQ ID NO: 4050 - protein, 14 aa, Artificial Sequence
  source: /note="Description of Artificial Sequence: Synthetic peptide"
TGGNNQPNIPDIPA

SEQ ID NO: 4051 - protein, 12 aa, Artificial Sequence
  source: /note="Description of Artificial Sequence: Synthetic peptide"
GGNNQPNIPDIP

SEQ ID NO: 4052 - protein, 13 aa, Artificial Sequence
  source: /note="Description of Artificial Sequence: Synthetic peptide"
GGNNQPNIPDIPA

SEQ ID NO: 4053 - protein, 12 aa, Artificial Sequence
  source: /note="Description of Artificial Sequence: Synthetic peptide"
GNNQPNIPDIPA

SEQ ID NO: 4054 - protein, 11 aa, Artificial Sequence
  source: /note="Description of Artificial Sequence: Synthetic peptide"
NNQPNIPDIPA

SEQ ID NO: 4055 - protein, 10 aa, Artificial Sequence
  source: /note="Description of Artificial Sequence: Synthetic peptide"
NQPNIPDIPA

SEQ ID NO: 4056 - protein, 8 aa, Artificial Sequence
  source: /note="Description of Artificial Sequence: Synthetic peptide"
PNIPDIPA

SEQ ID NO: 4057 - DNA, 44 bp, Artificial Sequence
  source: /note="Description of Artificial Sequence: Synthetic oligonucleotide"
atcaccaccatcaccatcatagcagcagcgaaagcattcgtatg

SEQ ID NO: 4058 - DNA, 47 bp, Artificial Sequence
  source: /note="Description of Artificial Sequence: Synthetic oligonucleotide"
tgttagcagccggatccttaatctttgcccagtttattcagaatatc

SEQ ID NO: 4059 - DNA, 48 bp, Artificial Sequence
  source: /note="Description of Artificial Sequence: Synthetic primer"
ggaatggtacgcggaaaaccaaacagaataaagccatttttgcatgcc

SEQ ID NO: 4060 - DNA, 48 bp, Artificial Sequence
  source: /note="Description of Artificial Sequence: Synthetic primer"
ggaatggtacgcggaaaaccaatcagaataaagccatttttgcatgcc

SEQ ID NO: 4061 - DNA, 44 bp, Artificial Sequence
  source: /note="Description of Artificial Sequence: Synthetic primer"
ccgcttgccggatgaatcagcataccggtaatacgtgcaaccag

SEQ ID NO: 4062 - DNA, 44 bp, Artificial Sequence
  source: /note="Description of Artificial Sequence: Synthetic primer"
ccgcttgccggatgaatcagataaccggtaatacgtgcaaccag

SEQ ID NO: 4063 - DNA, 44 bp, Artificial Sequence
  source: /note="Description of Artificial Sequence: Synthetic primer"
gtaccttttgcaatctggcttgccagcatatcaccggttgccag

SEQ ID NO: 4064 - DNA, 44 bp, Artificial Sequence
  source: /note="Description of Artificial Sequence: Synthetic primer"
gtaccttttgcaatctggctacacagcatatcaccggttgccag

SEQ ID NO: 4065 - DNA, 44 bp, Artificial Sequence
  source: /note="Description of Artificial Sequence: Synthetic primer"
gtaccttttgcaatctggctacccagcatatcaccggttgccag

SEQ ID NO: 4066 - DNA, 44 bp, Artificial Sequence
  source: /note="Description of Artificial Sequence: Synthetic primer"
gtaccttttgcaatctggctaatcagcatatcaccggttgccag

SEQ ID NO: 4067 - DNA, 44 bp, Artificial Sequence
  source: /note="Description of Artificial Sequence: Synthetic primer"
gtaccttttgcaatctggcttttcagcatatcaccggttgccag

SEQ ID NO: 4068 - DNA, 44 bp, Artificial Sequence
  source: /note="Description of Artificial Sequence: Synthetic primer"
gtaccttttgcaatctggctcagcagcatatcaccggttgccag

SEQ ID NO: 4069 - DNA, 44 bp, Artificial Sequence
  source: /note="Description of Artificial Sequence: Synthetic primer"
gtaccttttgcaatctggctctgcagcatatcaccggttgccag

SEQ ID NO: 4070 - DNA, 44 bp, Artificial Sequence
  source: /note="Description of Artificial Sequence: Synthetic primer"
gtaccttttgcaatctggctggtcagcatatcaccggttgccag

SEQ ID NO: 4071 - DNA, 44 bp, Artificial Sequence
  source: /note="Description of Artificial Sequence: Synthetic primer"
gtaccttttgcaatctggctaaccagcatatcaccggttgccag

SEQ ID NO: 4072 - DNA, 20 bp, Artificial Sequence
  source: /note="Description of Artificial Sequence: Synthetic primer"
ggttttccgcgtaccattcc

SEQ ID NO: 4073 - DNA, 19 bp, Artificial Sequence
  source: /note="Description of Artificial Sequence: Synthetic primer"
ctgattcatccggcaagcg

SEQ ID NO: 4074 - DNA, 22 bp, Artificial Sequence
  source: /note="Description of Artificial Sequence: Synthetic primer"
agccagattgcaaaaggtacac

SEQ ID NO: 4075 - DNA, 22 bp, Artificial Sequence
  source: /note="Description of Artificial Sequence: Synthetic primer"
ggatccggctgctaacaaagcc

SEQ ID NO: 4076 - DNA, 26 bp, Artificial Sequence
  source: /note="Description of Artificial Sequence: Synthetic primer"
atgatggtgatggtggtgatgatgac

SEQ ID NO: 4077 - DNA, 70 bp, Artificial Sequence
  source: /note="Description of Artificial Sequence: Synthetic primer"
  modified_base (26)..(26): a, c, t, g, unknown or other
  modified_base (28)..(29): a, c, t, g, unknown or other
  modified_base (31)..(31): a, c, t, g, unknown or other
  modified_base (35)..(35): a, c, t, g, unknown or other
  modified_base (37)..(38): a, c, t, g, unknown or other
  modified_base (40)..(40): a, c, t, g, unknown or other
ggtcatcaatcataccaccagtgatntnntnggcntnntntccaatgaggttaagagtattccaaactgg

SEQ ID NO: 4078 - DNA, 62 bp, Artificial Sequence
  source: /note="Description of Artificial Sequence: Synthetic primer"
  modified_base (27)..(27): a, c, t, g, unknown or other
  modified_base (29)..(29): a, c, t, g, unknown or other
  modified_base (31)..(32): a, c, t, g, unknown or other
  modified_base (34)..(34): a, c, t, g, unknown or other
  modified_base (36)..(36): a, c, t, g, unknown or other
cagtcaattttggccgaatatcacaanrntnntnanrgagttccaatacggagaaatcctgc

SEQ ID NO: 4079 - DNA, 66 bp, Artificial Sequence
  source: /note="Description of Artificial Sequence: Synthetic primer"
  modified_base (26)..(26): a, c, t, g, unknown or other
  modified_base (28)..(28): a, c, t, g, unknown or other
  modified_base (30)..(30): a, c, t, g, unknown or other
  modified_base (35)..(35): a, c, t, g, unknown or other
  modified_base (37)..(38): a, c, t, g, unknown or other
  modified_base (40)..(40): a, c, t, g, unknown or other
  modified_base (42)..(42): a, c, t, g, unknown or other
tcgtaatctgggcgtgtcgaatatcntnanrtatntnntnanrgtgtctgcggacaagctagtgac

SEQ ID NO: 4080 - DNA, 56 bp, Artificial Sequence
  source: /note="Description of Artificial Sequence: Synthetic primer"
  modified_base (24)..(24): a, c, t, g, unknown or other
  modified_base (26)..(26): a, c, t, g, unknown or other
  modified_base (31)..(31): a, c, t, g, unknown or other
  modified_base (34)..(34): a, c, t, g, unknown or other
gatttcacaatgtgatggctggantncctanranrctctcgaacccgaatggaaac

SEQ ID NO: 4081 - DNA, 23 bp, Artificial Sequence
  source: /note="Description of Artificial Sequence: Synthetic primer"
ggtcatcaatcataccaccagtg

SEQ ID NO: 4082 - DNA, 24 bp, Artificial Sequence
  source: /note="Description of Artificial Sequence: Synthetic primer"
cagtcaattttggccgaatatcac

SEQ ID NO: 4083 - DNA, 19 bp, Artificial Sequence
  source: /note="Description of Artificial Sequence: Synthetic primer"
tcgtaatctgggcgtgtcg

SEQ ID NO: 4084 - DNA, 22 bp, Artificial Sequence
  source: /note="Description of Artificial Sequence: Synthetic primer"
gatttcacaatgtgatggctgg

SEQ ID NO: 4085 - DNA, 25 bp, Artificial Sequence
  source: /note="Description of Artificial Sequence: Synthetic primer"
tgtgatattcggccaaaattgactg

SEQ ID NO: 4086 - DNA, 24 bp, Artificial Sequence
  source: /note="Description of Artificial Sequence: Synthetic primer"
gatattcgacacgcccagattacg

SEQ ID NO: 4087 - DNA, 23 bp, Artificial Sequence
  source: /note="Description of Artificial Sequence: Synthetic primer"
tccagccatcacattgtgaaatc

SEQ ID NO: 4088 - DNA, 24 bp, Artificial Sequence
  source: /note="Description of Artificial Sequence: Synthetic primer"
atctgcacgcaaggtaatcgtcag

SEQ ID NO: 4089 - DNA, 22 bp, Artificial Sequence
  source: /note="Description of Artificial Sequence: Synthetic primer"
ctgacgattaccttgcgtgcag

SEQ ID NO: 4090 - DNA, 23 bp, Artificial Sequence
  source: /note="Description of Artificial Sequence: Synthetic primer"
cactggtggtatgattgatgacc

SEQ ID NO: 4091 - DNA, 70 bp, Artificial Sequence
  source: /note="Description of Artificial Sequence: Synthetic primer"
ggtcatcaatcataccaccagtgatcttctgggccttctgtccaatgaggttaagagtattccaaactgg

SEQ ID NO: 4092 - DNA, 70 bp, Artificial Sequence
  source: /note="Description of Artificial Sequence: Synthetic primer"
ggtcatcaatcataccaccagtgatattatcggcattatctccaatgaggttaagagtattccaaactgg

SEQ ID NO: 4093 - DNA, 70 bp, Artificial Sequence
  source: /note="Description of Artificial Sequence: Synthetic primer"
ggtcatcaatcataccaccagtgatgttgtgggcgttgtgtccaatgaggttaagagtattccaaactgg

SEQ ID NO: 4094 - DNA, 70 bp, Artificial Sequence
  source: /note="Description of Artificial Sequence: Synthetic primer"
ggtcatcaatcataccaccagtgattttttcggctttttctccaatgaggttaagagtattccaaactgg

SEQ ID NO: 4095 - DNA, 70 bp, Artificial Sequence
  source: /note="Description of Artificial Sequence: Synthetic primer"
ggtcatcaatcataccaccagtgattggtggggatggtggtccaatgaggttaagagtattccaaactgg

SEQ ID NO: 4096 - DNA, 70 bp, Artificial Sequence
  source: /note="Description of Artificial Sequence: Synthetic primer"
ggtcatcaatcataccaccagtgatatgatgggcatgatgtccaatgaggttaagagtattccaaactgg

SEQ ID NO: 4097 - DNA, 70 bp, Artificial Sequence
  source: /note="Description of Artificial Sequence: Synthetic primer"
ggtcatcaatcataccaccagtgatacaacgggcacaacgtccaatgaggttaagagtattccaaactgg

SEQ ID NO: 4098 - DNA, 70 bp, Artificial Sequence
  source: /note="Description of Artificial Sequence: Synthetic primer"
ggtcatcaatcataccaccagtgattataagaaaggcaagaaaaatgaggttaagagtattccaaactgg

SEQ ID NO: 4099 - DNA, 70 bp, Artificial Sequence
  source: /note="Description of Artificial Sequence: Synthetic primer"
ggtcatcaatcataccaccagtgattatcatcatggccatcacaatgaggttaagagtattccaaactgg

SEQ ID NO: 4100 - DNA, 62 bp, Artificial Sequence
  source: /note="Description of Artificial Sequence: Synthetic primer"
cagtcaattttggccgaatatcacaaagcttctgggcgagttccaatacggagaaatcctgc

SEQ ID NO: 4101 - DNA, 62 bp, Artificial Sequence
  source: /note="Description of Artificial Sequence: Synthetic primer"
cagtcaattttggccgaatatcacaaagattatcggcgagttccaatacggagaaatcctgc

SEQ ID NO: 4102 - DNA, 62 bp, Artificial Sequence
  source: /note="Description of Artificial Sequence: Synthetic primer"
cagtcaattttggccgaatatcacaaaggttgtgggcgagttccaatacggagaaatcctgc

SEQ ID NO: 4103 - DNA, 62 bp, Artificial Sequence
  source: /note="Description of Artificial Sequence: Synthetic primer"
cagtcaattttggccgaatatcacaaagttctttggcgagttccaatacggagaaatcctgc

SEQ ID NO: 4104 - DNA, 62 bp, Artificial Sequence
  source: /note="Description of Artificial Sequence: Synthetic primer"
cagtcaattttggccgaatatcacaaagtggtggggcgagttccaatacggagaaatcctgc

SEQ ID NO: 4105 - DNA, 62 bp, Artificial Sequence
  source: /note="Description of Artificial Sequence: Synthetic primer"
cagtcaattttggccgaatatcacaaagatgatgggcgagttccaatacggagaaatcctgc

SEQ ID NO: 4106 - DNA, 62 bp, Artificial Sequence
  source: /note="Description of Artificial Sequence: Synthetic primer"
cagtcaattttggccgaatatcacaaagacgacaggcgagttccaatacggagaaatcctgc

SEQ ID NO: 4107 - DNA, 62 bp, Artificial Sequence
  source: /note="Description of Artificial Sequence: Synthetic primer"
cagtcaattttggccgaatatcacaaagaaaggagcagagttccaatacggagaaatcctgc

SEQ ID NO: 4108 - DNA, 62 bp, Artificial Sequence
  source: /note="Description of Artificial Sequence: Synthetic primer"
cagtcaattttggccgaatatcacacatcatggagcagagttccaatacggagaaatcctgc

SEQ ID NO: 4109 - DNA, 66 bp, Artificial Sequence
  source: /note="Description of Artificial Sequence: Synthetic primer"
tcgtaatctgggcgtgtcgaatatccttcactatcttctggatgtgtctgcggacaagctagtgac

SEQ ID NO: 4110 - DNA, 66 bp, Artificial Sequence
  source: /note="Description of Artificial Sequence: Synthetic primer"
tcgtaatctgggcgtgtcgaatatcattcactatatcattgatgtgtctgcggacaagctagtgac

SEQ ID NO: 4111 - DNA, 66 bp, Artificial Sequence
  source: /note="Description of Artificial Sequence: Synthetic primer"
tcgtaatctgggcgtgtcgaatatcgttcactatgttgtggatgtgtctgcggacaagctagtgac

SEQ ID NO: 4112 - DNA, 66 bp, Artificial Sequence
  source: /note="Description of Artificial Sequence: Synthetic primer"
tcgtaatctgggcgtgtcgaatatcttccactatttctttgatgtgtctgcggacaagctagtgac

SEQ ID NO: 4113 - DNA, 66 bp, Artificial Sequence
  source: /note="Description of Artificial Sequence: Synthetic primer"
tcgtaatctgggcgtgtcgaatatctggcactattggtgggatgtgtctgcggacaagctagtgac

SEQ ID NO: 4114 - DNA, 66 bp, Artificial Sequence
  source: /note="Description of Artificial Sequence: Synthetic primer"
tcgtaatctgggcgtgtcgaatatcatgcactatatgatggatgtgtctgcggacaagctagtgac

SEQ ID NO: 4115 - DNA, 66 bp, Artificial Sequence
  source: /note="Description of Artificial Sequence: Synthetic primer"
tcgtaatctgggcgtgtcgaatatcacacactatacaacggatgtgtctgcggacaagctagtgac

SEQ ID NO: 4116 - DNA, 66 bp, Artificial Sequence
  source: /note="Description of Artificial Sequence: Synthetic primer"
tcgtaatctgggcgtgtcgaatatctccaagtataaagcaaaggtgtctgcggacaagctagtgac

SEQ ID NO: 4117 - DNA, 66 bp, Artificial Sequence
  source: /note="Description of Artificial Sequence: Synthetic primer"
tcgtaatctgggcgtgtcgaatatctcccattatcacgcacatgtgtctgcggacaagctagtgac

SEQ ID NO: 4118 - DNA, 56 bp, Artificial Sequence
  source: /note="Description of Artificial Sequence: Synthetic primer"
gatttcacaatgtgatggctggacttcctgaggaactctcgaacccgaatggaaac

SEQ ID NO: 4119 - DNA, 56 bp, Artificial Sequence
  source: /note="Description of Artificial Sequence: Synthetic primer"
gatttcacaatgtgatggctggaattcctgaggaactctcgaacccgaatggaaac

SEQ ID NO: 4120 - DNA, 56 bp, Artificial Sequence
  source: /note="Description of Artificial Sequence: Synthetic primer"
gatttcacaatgtgatggctggagttcctgaggaactctcgaacccgaatggaaac

SEQ ID NO: 4121 - DNA, 56 bp, Artificial Sequence
  source: /note="Description of Artificial Sequence: Synthetic primer"
gatttcacaatgtgatggctggattccctgaggaactctcgaacccgaatggaaac

SEQ ID NO: 4122 - DNA, 56 bp, Artificial Sequence
  source: /note="Description of Artificial Sequence: Synthetic primer"
gatttcacaatgtgatggctggatggcctgaggaactctcgaacccgaatggaaac

SEQ ID NO: 4123 - DNA, 56 bp, Artificial Sequence
  source: /note="Description of Artificial Sequence: Synthetic primer"
gatttcacaatgtgatggctggaatgcctgaggaactctcgaacccgaatggaaac

SEQ ID NO: 4124 - DNA, 56 bp, Artificial Sequence
  source: /note="Description of Artificial Sequence: Synthetic primer"
gatttcacaatgtgatggctggaacacctgaggaactctcgaacccgaatggaaac

SEQ ID NO: 4125 - DNA, 56 bp, Artificial Sequence
  source: /note="Description of Artificial Sequence: Synthetic primer"
gatttcacaatgtgatggctggaaagcctgaggaactctcgaacccgaatggaaac

SEQ ID NO: 4126 - DNA, 56 bp, Artificial Sequence
  source: /note="Description of Artificial Sequence: Synthetic primer"
gatttcacaatgtgatggctggacatcctgaggaactctcgaacccgaatggaaac

SEQ ID NO: 4127 - DNA, 22 bp, Artificial Sequence
  source: /note="Description of Artificial Sequence: Synthetic primer"
cttgaaattggaagggagattc

SEQ ID NO: 4128 - DNA, 23 bp, Artificial Sequence
  source: /note="Description of Artificial Sequence: Synthetic primer"
gtataaacttttcagttgcagac

SEQ ID NO: 4129 - protein, 6 aa, Artificial Sequence
  source: /note="Description of Artificial Sequence: Synthetic 6xHis tag"
HHHHHH

SEQ ID NO: 4130 - protein, 4 aa, Bacillus subtilis
YAAI

SEQ ID NO: 4131 - protein, 4 aa, Bacillus subtilis
NTSA

SEQ ID NO: 4132 - protein, 6 aa, Bacillus subtilis
SHYASD

SEQ ID NO: 4133 - protein, 4 aa, Bacillus subtilis
QPEE
